United States Patent 7,745,391 (HUMAN THROMBOSPONDIN POLYPEPTIDE) - sequence listing, part 105

SEQ ID NO: 317771 - DNA, 6783 bp, Homo sapiens
cgtattggataaatgacccaggagacataatcagtaaagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317772 - DNA, 6746 bp, Homo sapiens
tactattgcattcatgaagaaggagggagatgaaaaattaggcattctaactgggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317773 - DNA, 6860 bp, Homo sapiens
taggatttttaaactcaagtgattttggggggtttctccccacctcaaactcttgccccccagttttggcatcttctttcctgtggttcactgaagtgcctttttgcagtccaggatccactgaccgctgagtttgagcagcccgatctgacatgatgtacctctggggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317774 - DNA, 6920 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317775 - DNA, 6469 bp, Homo sapiens
ggaagagagcttcagagaaacgtggaacaccattaactgctccaacatacacttagtatctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgttcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317776 - DNA, 6297 bp, Homo sapiens
tcactgctctcagaaatttacattttaaactaaatactctgttattggatgtgcaactttatgttccctaatgtggtccacttcttccctgcccttttttctccttgttatttttaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggaatagtcttacaggaaccaatcattagcgctaaaatacctcagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317777 - DNA, 5871 bp, Homo sapiens
tgtgggcgggtgtgtgtttttctgtacacctggggggagaggtatctgtaaagtcagttctcttctctcctgtagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317778 - DNA, 3877 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317779 - DNA, 2407 bp, Homo sapiens
  misc_feature (2334)..(2334): n is a, c, g, or t
  misc_feature (2372)..(2372): n is a, c, g, or t
  misc_feature (2383)..(2383): n is a, c, g, or t
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggaaatnaggctggtttgaagagggtagaaagcaataaaggcagnaaaaaataagnctaaaatcaggggaagatgtattt

SEQ ID NO: 317780 - DNA, 1066 bp, Homo sapiens
cggagtattagcaggcgtaccgtttttatttagtacatgggactgggttagttaacatactgggcgtgccgtacaatcaaaagcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcattgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317781 - DNA, 783 bp, Homo sapiens
ggaagagagcttcagagaaacgtggaacaccattaactgctccaacatacacttagtatctgccagagaggaagagaaaagaaaggaagaaacattagaaagaaaaaggaaggaaaacggtataaagagagatcaattacccacccttaaatagctagattggggggggaggggggtggaaaagaaagctgtggaggtgtgccccagcacggctgctttgaaaggtttatcatctatccgtttggtttatggagaaaaagaaaatggtaactcagggtaaccaggagccgacaacaactcctgacgcaatggttcagccttttactaccatcccatttccaccacctccgcagaatggaattcccacagatgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317782 - DNA, 381 bp, Homo sapiens
gttaaataagtagtttactgaagaagaaaaataaactattcccatttcagaagataacaaaatatgtggataaaaacctgaccataagtaaacgtttttatttttatctctgcagcagtttggcaaaatcctagatgtagaaataatctttaatgaacgtggctctaaggtaagctccatttcagtgtcaagtgtgcttgatttctttttgagttttatgttattttaaatagcaagtattcagaaaacataagctgttttcaagcctgcataaaagtatcctaattatccaccttggtttagattatctctaaaaataagctaccacatggccaaactttattctgatacttatatgggggtggaagggtgatgaagtaa

SEQ ID NO: 317783 - DNA, 411 bp, Homo sapiens
caatttgtgactcctttttaatcttcttgcatttttaaattttttaaaaatccaatcagcatccagctttcaagcagatgtgtccctaggcaatgatgcagcagtgcccctatcaggaagagggggtatcaacacttacattcctttaatcagtaagtagcctatgttggcctggcatggattttgactgttgtgagtgaactatcatgtactgtttttttttttcctagtacagtacataactgaaatggaaatttcttgagagggatattaaatactatcccagtgccctgtcctgcttaacctgtgctagaattttcctgaccaaatattaagattgcacaaagcagaaatagttggaaaaggtagagggggtaagggcatatgaagaatattttagtctgtacttga

SEQ ID NO: 317784 - DNA, 7012 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317785 - DNA, 7031 bp, Homo sapiens
cggagtattagcaggcgtaccgtttttatttagtacatgggactgggttagttaacatactgggcgtgccgtacaatcaaaagcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317786 - DNA, 7015 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggaatagtcttacaggaaccaatcattagcgctaaaatacctcagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317787 - DNA, 6848 bp, Homo sapiens
atggtagctgtgtgcaaggggagagcagcagggtttagaattccaggaaggaagagagagtgatgtcatcagattccatggaccagcccaggaacccctgtgagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317788 - DNA, 4063 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317789 - DNA, 6807 bp, Homo sapiens
ggagggagctggagaaagaaggagggggagagactgccagagaggaagagaaaagaaaggaagaaacattagaaagaaaaaggaaggaaaacgaaaaagaaaatggtaactcagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317790 - DNA, 6768 bp, Homo sapiens
taagcggacctgaaggtgtcctgctctgaacgtgctctgaccaggttatcatggattcccagcgcgggacagccaggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317791 - DNA, 6448 bp, Homo sapiens
aacatagaagttaaataagtagtttactgaagaagaaaaataaactattcccatttcagaagataacaaaatatgtggataaaaacctgaccataagtaaacgtttttatttttatctctgcagcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317792 - DNA, 6928 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgttttaaacaggactcgccgtgtctcgcgtcgtgcgcgcgggggtggaggcggtgtgggggtg

SEQ ID NO: 317793 - DNA, 5932 bp, Homo sapiens
aacttgttttcaactgtgtattgtttcccttctgtgctaattcatgtaaataatgaaataaaatgtcgtcatactctccttgagaatatcaggtcagcaataaatgtgttgggctctggtctgagcaccttagaagcagaagttggtttcctgacttcactgcacaaggcaatgcttgatcagttgctttgaggcttcgaagcaggctgtttctagatccctctctggacatttttcttcactgttaatgcttctctcatcaaccttttaattatttttatctctttaattactgcaggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaattgttgacagccattaaagagggtgaggaagggaaaaggaatattagaagatctggtatttcttacttttttcttgcctcagaaagtacaaagtttaaaaaatagaataaagaatctgctggggaaagatagagtaccaggtcctaggtcagtagtccctggaagttttggtgatgaggacatggaagggcaggcagaggcactttgtacttgctccaaagccataggaattttcatcttccagagcctttatgagtcacttctctatccacagtcttgagcctgtggctatcccgctgagcttctcactgtcctccaaaaacaccccgctgagcacccggaccactttgtacacattaacactacaggacataaaatgcagaggccctgagattgctgccctcccatattggaaggagggtctgcgatggcaagggtcttctatatcaccagaaagagtcgcgcagtgagtcactgccgttgccatctggctgtaattttctatgttatcaaggtaggagggagtgtttctcttctagctgttagatagaactgataaaagcaagtgtcctacagcatttcccaaatgaaggcattaggaaatagaaaagcacggtctttttggctccctggtctagtcacattggtactagggtgacctttcacccaagggacagctgctaaagggagtaattcagagacatggagcttctggttatgggtttgttttgggtttgtttttaactcctgcctccacacatgttcttgactgataactgactcatgtccctgaattaaaatgactgacctatgacagcatcagcattctttgtaagcagagtgatatatctgagagggcgttgacctgttgtgtagaatacatatcctttcccccttcagaatcctgtctcgcctcgtaactgggagagaggctgtgcctgaaactaggggcgatgtcaaggaagctagaggcctcgatgcaattattactgactctggggaggaagacagagaataaggggacaccaactgcccagtccactggccatttttaagggtccccccaccccaagccaaagtttggtttgttgctgttaagacaatttttgttgtatgtatataaatattttagttagaggagcggggaatgggatgcgggctttcacagttctagggaatgggggcagggaggattttgcttttgcttttgctttgagggagaactttagctgactaaaaaaacagaagtttggggtcatgatcacaaaggggccattcccaaaagatggcaagccacgtattcagtggagactaggccaaattctaaatggttttatccatagcaggggagaataggagaatgagtttaagagtttttctcttcttttttcctagaaagaggtaaggataatgggaaaggtagagaaggcggctcccacagaccttttaagagaggcagaatcttgagcttgaggcaccttgagtgcatctcagttcagctggttctggctgaggcctccaaaggcaagctctgtgctttccagtggtttctgctgcatttccagggatggtgtttaacaccgcttcctccagctcccttttctaagaaagaataaatggagttctgctttttatgaaagggtctttggttttcagtgtcaacactgagaattggggctcttgcaagcatctggatttcacagtatcaacctccccgtcaccttttgaactttgagactccgtacggtcaacttcaccagaggcaggttgctcgaagcagcactgcttgtctgttcctgactctggttctcactgtattaaaaaaagagagtcagaggagtctggcatttcgtgagtttgttagaggatgctggctgataattccagaaaacttactgatgctaaatcacagtacatgcatgattctttttcagctttactatagttcatgacctggactttctgtactcttggaagctgggctccttaaaggaggcctctagtgaacacctttatctccatgtccctcttagagcccagagagctgcccataggcattttccagaattcctcatgtcacctagttcaatttccattaactcagatcagccattgtgattcaccatttgtcaggctctcaggtttaacaaaacctactatcaccatcatccttcaacagccacagtctgaattgagccaacatttttttttctttgagaaagaagtggactggggcacaacttttagtctgaggggagctagtggaaatctagacaatagaagtcatcgatagcagcttttcctcaaatgtgtgactcctcaggggctaaactgctcttagcttagaattatgctttactagagatctagcagataagtgggttaatcactaccatcctgtaactagttatatagcttccagacatgagggagacatcaaacagggatggaagcaaccccaaggatatgcaagaagggcatgatgaacccccttccctctggcaggagaacaaggccaaccaagggacagactggaaagcacttagatgtttaaggaggagaaaggggaagctttgaccagtccttgccttttgccaagttcagccagttctccgctgcttgcaacctctagcgcagtaacatttgcagaattgcagattttcccccagatactaggaggaaagggactttggggggtggggaaggggtcgtggtgttttaaaagcataagttacctgtttgcactgttttaagataggaaaaaaaaatagtgggcaaggtgaacatcagacgtaaatttgtgtgtttttattttgtcatgctcttgaaaatgtttgaccatttgtagtatacacagtgaaacttgattctctgttgcataaaacactatatttttttggaaatgttactgtccaaaagcctcttccctccctttccttttcctatgtacttccttcatacttgctttactgatcagccaggcaatagccatccaagagctagagcatgaaacagggccctttccaagtaggctctgggtgtcctaagccagcgtgtgccctctggtttagtgagtgtaatagagtccctggcacctttctttgcaaatgaggctaacagaccagactgcagcaagttatcagattcctcaatcagatgcactaggagtgaggagcccagggatggagggggttcctgaagtattgcagttggctgtagtagctgagttcttttccatgttaccgaaactgtagccagttacagtttactcaggaaaacggtagatcaattcagccatggtagtgctggttggcagggattggtaacggagagaactgctcatcagccaaaactcaagccttgccttttaggaggccaccagcagagggacttggtcctccttgtctggtacttgtgtacatgccggtgacctgaggactccactcacactggcgagcaaaaagggagcagtgattctcttttctctccccaccccctgccctttgttaccaacaccagtttcccagggggtacatgagtttctgaatttttaaaaaatgtttttggtttggtttttctggggactgataagtgctttaagcaatgtccataccccgtcaagactcccagcttagtcattttcttgtatttttctgttcacagtatttgtgtgtgtgcttgttttggcagctcattttggctgtattatatattgagtgatgaattgatcctcttttttccctaagggatatgaattgtttttcttgtgttatattctgcttgtgaatagctggagcaaacctggggctgacacgcgtaagctagggctgcaaagcgagaagagagccggtggagtgtacttgtccctgacaggctgacctacctgagtctctgagcttttcagtccaaatctttgcaaggctcaaaatgccacagaacctctcctcttctccccactccccatggcagggaccggaccatccctacatgcaacatgctgttcctccagcccctcccattgccatggcaaaacaggtacctttggggcatgggggcattacatgggatgcttgtgtaatcgaccacctagccttctctctcccctcccgtcctcccccagaatcacttcctaggacacccgagctgcttgcccagggtcctgtttccctgctaactccagagaagcatcccagggctttgtgacagtctctaattcccttcccttctcgttaagaatcatattgtatagtagctttcagaccatacagtattcattgggttactcctattattatcaagtagctggaattgtgaaggtcggagtagttagatctttagcttttattccttatttttttgtattactctccatgtgtataaattattgatcatgttgctggcttttataaactctaagcgaaggaggagcactgcctcagcctttgcacatggtaatgaagcactgtttttaaataaaagagagaaacaccaaaaaaaaaaaaaagacacacaggggggggctaaattccgagggccgagtaacgtcccggttttgaaaggcctaagggggaaaaaagacggcggaaaccgagggaagcacggttgagagcc

SEQ ID NO: 317794 - DNA, 2503 bp, Homo sapiens
  misc_feature (2491)..(2491): n is a, c, g, or t
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggtgtggtttaccaggacggattttacggtgctgacctctatggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactatgttctttgaatatgtatttttcctttaaatttctgcctttaattcttttgttccaaagattgtgcatttttttctttttttttttaaactgtggtaaaaaaaaaaaaaataatgcatttccatgtctgtatgtccgtgcttagcttattctatcaatcacggaagaggcagtcaaggaggaaggagagacattaggagccgataaatgcatctgatcagaaatcagcagacagaattaccaaagtgtatctggtgctgaatgactgggggacaagcagaagtggaagagatctttctgcaacaggatattcttctagtcttctgagtttctggtctttgacaggcaattctggttggctgtggctggaatccacatgctgatagataggaatttgtgcttacaaagcaggagaattaaaaagacgctttcctctcctcttccctcctgtcttctccgttctttttacaatcatcttacacgcacagcctgagacagctggcatagtttttggaattatagtattgatatttccaaacgtgctctcagacagtggataataaacacctcattaggaaaccgatctcagaatgaactctggagtatgaaaaagatcatttctttttgttcctgtaacctagcattccttctaggcttcttctcctttaattgaaccacagcttagctcatgtattcttttattaacaccctgctctcatgtccataagattcaggaatttaggacccagggacagaaaagtgaataagccagtgaccagatttcccccagatgtcttgaggattagaagtacaaatgggacagccccccagttcatgaggcctggctattgcaatatttactagtagaggaactctatagcaagatgaagaggaaaaacaaacanacaaacaaaaaa

SEQ ID NO: 317795 - DNA, 1810 bp, Homo sapiens
cgcgacagtcggggccgaggcccagggggaggtggcctgtcgcgggtcgcccggctcccggaggcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccagggtaaccaggagccgacaacaactcctgacgcaatggttcagccttttactaccatcccatttccaccacctccgcagaatggaattcccacagagtatggggtgccacacactcaagactatgccggccagaccggtgagcataacctgacactctacggaagtacgcaagcccacggggagcagagcagcaactcacccagcacacaaaatggatctcttacgacagaaggtggagcacagacagacggccagcagtcacagacacaaagtagtgaaaattcagagagtaaatctaccccgaaacggctgcatgtctctaatattcctttccgcttccgggaccctgacctccggcagatgtttgggcagtttggcaaaatcctagatgtagaaataatctttaatgaacgtggctctaagggattcgggttcgtaactttcgagaatagtgctgatgcagacagggccagggagaaattacacggcaccgtggtagagggccgtaaaatcgaggtgaataatgctacagcacgtgtaatgaccaataagaagatggtcacaccatatgcaaatggttggaaattaagcccagtagttggagctgtatatggtccggagttatatgcagcatccagctttcaagcagatgtgtccctaggcaatgatgcagcagtgcccctatcaggaagagggggtatcaacacttacattcctttaatcattcctggcttcccttaccctactgcagccaccacggcagccgctttcagaggagcccatttgaggggcagagggcggacagtatatggtgcagtccgagcggtacctccaacagccatccccgcctatccaggggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggaactctatagcaagatgaagaggaaaaacaaacaaacaaacaaaaaaaaacacaaaaaaagaaagaatacttttttatacctcactgaaccaaggaggtgaaagacctctaaaaggaaaactacaaaaacactgctgaaagaaatcacagatggcacaaacaactggaaacaaattcccggctcatggatatgtagaatcaatattgtgaaaatgaccacactgccaaaagcaatctacaaattgaatgcaattcaaatcaaaataccaccataattcttcacagaactagaaaaaaataattctaaaattcatatgaaacccaaaaaagagtctgtatagccaaagcaa

SEQ ID NO: 317796 - DNA, 972 bp, Homo sapiens
cggagtattagcaggcgtaccgtttttatttagtacatgggactgggttagttaacatactgggcgtgccgtacaatcaaaagcgaggggggcgcgggcggatggcggagggcgcccagccgcagcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagaacgagcctctgactccaggttatcatggattcccagcgcgggacagccaggttggtatctgctgtttgtaactcagatgatgtatgtgtgtggtgtgtttcatcaaagggttgctatgatagagagcatttcctgaaattacttactttgaaaggaaatgtggcttgtttcagcagtgaatttacttttacagatgtaaattaagcatatttttaaattctataagtattatgttattaaaattgtggatattagaagagaaaataatcactcaagcacagtcatgattggttttgtattttcttctccaggctacataataattttttgacctggttttcttgatgccttataattctgaatgctggacttgtctctttattacctgccagttagcccctgcctgcacagagtttttgagtccttgtaatgatctgtagcaagaaaattccattctcctccctgggggaattcagccttatggttttaatcagggaaagcttgcctgagaaagcaaagtttctgccacctttctttgttagatgggaggatgactggaaaagcccaggccctattatgggtcagagcagaattgcttcctacgagacaccctcagtatggtttaggcaagtgtgtaaaatgccttccctatctttttgttgtttgaatacttgagcccatgac

SEQ ID NO: 317797 - DNA, 2752 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 317798 - DNA, 235 bp, Homo sapiens
gggccaagatgttcgctcgacgctaggtctattcagaattgaacagcaagttgtacccacagctgttaggatagggattgaaggtgtgcccccaagctcagaaaaaaatcctcccctctctccctggtcccctcccccatccccaccactgatatcatggggagtaataggaccagagcggtatctctggcaccacactagggactatcaggtaataaaagctttgactccctga

SEQ ID NO: 317799 - DNA, 450 bp, Homo sapiens
tctctacctggtgtggctgtgctctgcagtgagccacatgagcctgaatatactgttggggttccctggttggattccagtgtgccaagggtaaacaggagtatcccgaggtactcggtcaccccagcatgctgctgcctcagggtgtgcatgacctgtctctaaaaaagcccgattatttttaaaggcgatttagaaaggctgaattgatgagcaggaatacagaggtgtgatttgcctctcccacctctgtgctccattcttcactgtgatcattttctcattaggtttaagaaatacaagcaagctgggagccattccaattctttccgcttatccaacggccgcactgaggatgtgggtaaggcattccttaatgtcatggggaaccttcacaaggaaggaaatcaagaaattaggagtttctccatccttttaaaagaataagac

SEQ ID NO: 317800 - DNA, 1214 bp, Homo sapiens
gtaccttcccttccttcccatctgattccttatcagtatttacacatgattagttcttgcctaacctaatagaccctttcttgagtgcaaatcagtggctatttttgctagggtataaaaattacctatctaatcaccttgacaaagttaccctgttatttccaataacttacttcctatggattcttgtagattttcttttttttttttttaatttttttattttcagatgttttctcgctttgtcaccatgcctggcctaaattctcgtaggttttctatgtaaacaatcagattttctgcaagtattagtctcctttctaattgttataattttaatttctttttctttttaaaatttttcgtagagacaaggttttgctatgttgtccagcctggtcttgaactcctgggctcaagcaatcctcccatctcagcctcccaaatgtgtattacagtggcatgagccactgtgcctggccaaatttcttttcttgttgcgaaggcagacttttcatacaatactgaatagaagtgatagtagattactttatttctgattttcaaaggaatgctttccgtttctctctgttgaagataattgcgtattgtttttttttttaaatagtaacttttatcaggttaaggaaggtttcttctatttctatttaaaaggattttttaaaatcttgaattcatatgtttttatctaatgcattttctacatcagttgaaatggttgtatgaactcttttaatatgggtgaattatatttatagattttatgttaaaatatccttgtatatcttggataaactcaactggatcatgatttatctttttttatatgctagattcaatttgttgatactttgttatgatttttgaatatatattattgtgtaaaagtgagcctgtgattttctttcttgtaatgtttctgtccagttttggtgcctggttttgctctctccttagaatgagctgggaactagtcactcttgttttctcacctataatagcatctgggtccagtgttttttatgtgggacaaatttgaacttgtggtcaacctctttaattgtaaggatattcaggtcttttgttcttcctgggctagttttttattctttttctagagattcgttcatttttcttagttttatttgcctataattgtggataatctgttttttatctgctacttctgtaat

SEQ ID NO: 317801 - DNA, 5417 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 317802 - DNA, 5321 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 317803 - DNA, 5490 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccagtatccctgtgcacgccagaagggtaccctacagccaggggtggcaggggaaggggctggagatgcgtctgcaggtacctggcaagcggggcttattctccaactggatccttaaccgaggaaaatacagatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 317804 - DNA, 5498 bp, Homo sapiens
actgctgctgctgctgaattgcctcctgcagactctgctggtattgctggtatgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagctcgcccctggaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 317805 - DNA, 8198 bp, Homo sapiens
  misc_feature (7454)..(7454): n is a, c, g, or t
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctagacttcttcagaagcttgccagtttttcaagctgatttctctcactggcaactcttcagagtgctgttcctactccaccctcccctggtgataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatatattgtgttgaattgttcccattttctttcatacgtgtcctcatttctgggacagtgtgaatgtttctcagatctagaagtcagatggtgggagtcttagatccgaacttggttttgagtgacatgttagacaaaagtgttgaacttttgtttcttaaagaagctggatgttcatttatgtctcccgtaacagtctgtgctgtccagagacccagtatccttaggatattattctcatcctcatggttgaagctgggtcactgccatgtccataatccaccctgaggaaagagcatggagagccagcagcttcatttctaaggacaggaagccaaatctgcacttttcacttccactcataatccaccctgcattccactcatcagcttcacaagtaggttttcacctggtcatagctatgcctaactacagggagtgctggggaagtgtgatcttttgttgggggcacactgggagagtgggtctgtccactgcctcccagcctcagagcagctcaccacaggagcaggagagtgaactcgtggctgtggctgtcaggcagggcctttcttgagagccagcgcaggcctgggctcctcagaggcttctggagtgagagatggcacctcagcctggcccatggaggcatgttcagggatcagcactactgtgcttcttggaggaggtgggacttgagctggacccatgggaggctggaaatttagatgagtgaaaaggaggaaaggcgaagtagagccacattacagagggcctcagagtccagataaagcagttaacatgtagtggctccaggagggaagcctgtctgtgcaccacatacccaggatgtttgtgggaaggaaggagatgtgcggaagggacccaggagacctgcaggaggcaagggctgcaacagaccccctctggaagtttacaggaggtgagtgtgagtcattagagacattcagttctgtaggaactaacgaactcccaagaggcagtaaacttaaaactcagcagtctcgataagtatggataaattaggcaaagacagattctgaggaatttctggtgaggggtgccaagtttggggagcagcccctggctccttgcaagctacccttcagtgctctgtgtgaccaagtccaagtcgatgcaggagggcaggcactgggtcagcaagccactcagtgaatgtgcaggtgaggccgttcataggcgcttgtgtgcctcccagcaggctgcctgccattgccagggctggccttcagcagggtgcgccaccatggcctgagtggttttctgctgaagtccgtgctgatttggccagtggataggcatcacctgggtgcaaaaccattgtctccaggtaggaatgacctcagctgtttgctccgtgtctcgctcagcctgtagatgtgtccctcatcccttcatgcctccctcttcactcctcttttactttctactcggggcttgcatgtttacaagagaggtgaacccaacagaaactagtataggccaaaaggaaaatgtgctgaagctcacacagcacagtcgtgtggaaanggcagcagtgactgcttcatccagtgcccttcccacagccagtcagttgcgacccaaggggcttagggtaggagtgtttctccataggggaagagtaacagcctgcacccaccacacacccaaagccctacatcctgccacactgagacctcacttcatttgggcgggtccctcctgggttgcagtttccttcattgctcccctgtcccaaatactcaagtctctctcattaaaaataaagagcaggccaggtgcagtggctcacacctgtaatcccacactttgggaggccaaggcgggtggatcacttgagcccaggattcgagaccaacctgggcaacatgacaagatcctgtctctacaaaaaataacaaaaatcatctgggcatggaggcacacgcctgtagtcccagctacttgggaggctgaggtggaaggatcacctgagcccatgaggtggaggctacagtgagctgagatcacgccactgcactccagcctggatgacagcgagactccatctcaaaaaaaaaaaaagaaaaagaaaaagaattaattaattaattaaataaagagcatgtctcccaccccaggcctaagttcttccctctatgagagactacttgcagaaacctgtgttctcactcttcccccttcctcacttcattcccacacatttcttttccatccctgcgcaccaaggtcaccttggtgctaaacaccagggacccatggtctcttccc

SEQ ID NO: 317806 - DNA, 7929 bp, Homo sapiens
  misc_feature (7185)..(7185): n is a, c, g, or t
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatatattgtgttgaattgttcccattttctttcatacgtgtcctcatttctgggacagtgtgaatgtttctcagatctagaagtcagatggtgggagtcttagatccgaacttggttttgagtgacatgttagacaaaagtgttgaacttttgtttcttaaagaagctggatgttcatttatgtctcccgtaacagtctgtgctgtccagagacccagtatccttaggatattattctcatcctcatggttgaagctgggtcactgccatgtccataatccaccctgaggaaagagcatggagagccagcagcttcatttctaaggacaggaagccaaatctgcacttttcacttccactcataatccaccctgcattccactcatcagcttcacaagtaggttttcacctggtcatagctatgcctaactacagggagtgctggggaagtgtgatcttttgttgggggcacactgggagagtgggtctgtccactgcctcccagcctcagagcagctcaccacaggagcaggagagtgaactcgtggctgtggctgtcaggcagggcctttcttgagagccagcgcaggcctgggctcctcagaggcttctggagtgagagatggcacctcagcctggcccatggaggcatgttcagggatcagcactactgtgcttcttggaggaggtgggacttgagctggacccatgggaggctggaaatttagatgagtgaaaaggaggaaaggcgaagtagagccacattacagagggcctcagagtccagataaagcagttaacatgtagtggctccaggagggaagcctgtctgtgcaccacatacccaggatgtttgtgggaaggaaggagatgtgcggaagggacccaggagacctgcaggaggcaagggctgcaacagaccccctctggaagtttacaggaggtgagtgtgagtcattagagacattcagttctgtaggaactaacgaactcccaagaggcagtaaacttaaaactcagcagtctcgataagtatggataaattaggcaaagacagattctgaggaatttctggtgaggggtgccaagtttggggagcagcccctggctccttgcaagctacccttcagtgctctgtgtgaccaagtccaagtcgatgcaggagggcaggcactgggtcagcaagccactcagtgaatgtgcaggtgaggccgttcataggcgcttgtgtgcctcccagcaggctgcctgccattgccagggctggccttcagcagggtgcgccaccatggcctgagtggttttctgctgaagtccgtgctgatttggccagtggataggcatcacctgggtgcaaaaccattgtctccaggtaggaatgacctcagctgtttgctccgtgtctcgctcagcctgtagatgtgtccctcatcccttcatgcctccctcttcactcctcttttactttctactcggggcttgcatgtttacaagagaggtgaacccaacagaaactagtataggccaaaaggaaaatgtgctgaagctcacacagcacagtcgtgtggaaanggcagcagtgactgcttcatccagtgcccttcccacagccagtcagttgcgacccaaggggcttagggtaggagtgtttctccataggggaagagtaacagcctgcacccaccacacacccaaagccctacatcctgccacactgagacctcacttcatttgggcgggtccctcctgggttgcagtttccttcattgctcccctgtcccaaatactcaagtctctctcattaaaaataaagagcaggccaggtgcagtggctcacacctgtaatcccacactttgggaggccaaggcgggtggatcacttgagcccaggattcgagaccaacctgggcaacatgacaagatcctgtctctacaaaaaataacaaaaatcatctgggcatggaggcacacgcctgtagtcccagctacttgggaggctgaggtggaaggatcacctgagcccatgaggtggaggctacagtgagctgagatcacgccactgcactccagcctggatgacagcgagactccatctcaaaaaaaaaaaaagaaaaagaaaaagaattaattaattaattaaataaagagcatgtctcccaccccaggcctaagttcttccctctatgagagactacttgcagaaacctgtgttctcactcttcccccttcctcacttcattcccacacatttcttttccatccctgcgcaccaaggtcaccttggtgctaaacaccagggacccatggtctcttccc

SEQ ID NO: 317807 - DNA, 7778 bp, Homo sapiens
  misc_feature (7034)..(7034): n is a, c, g, or t
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatatattgtgttgaattgttcccattttctttcatacgtgtcctcatttctgggacagtgtgaatgtttctcagatctagaagtcagatggtgggagtcttagatccgaacttggttttgagtgacatgttagacaaaagtgttgaacttttgtttcttaaagaagctggatgttcatttatgtctcccgtaacagtctgtgctgtccagagacccagtatccttaggatattattctcatcctcatggttgaagctgggtcactgccatgtccataatccaccctgaggaaagagcatggagagccagcagcttcatttctaaggacaggaagccaaatctgcacttttcacttccactcataatccaccctgcattccactcatcagcttcacaagtaggttttcacctggtcatagctatgcctaactacagggagtgctggggaagtgtgatcttttgttgggggcacactgggagagtgggtctgtccactgcctcccagcctcagagcagctcaccacaggagcaggagagtgaactcgtggctgtggctgtcaggcagggcctttcttgagagccagcgcaggcctgggctcctcagaggcttctggagtgagagatggcacctcagcctggcccatggaggcatgttcagggatcagcactactgtgcttcttggaggaggtgggacttgagctggacccatgggaggctggaaatttagatgagtgaaaaggaggaaaggcgaagtagagccacattacagagggcctcagagtccagataaagcagttaacatgtagtggctccaggagggaagcctgtctgtgcaccacatacccaggatgtttgtgggaaggaaggagatgtgcggaagggacccaggagacctgcaggaggcaagggctgcaacagaccccctctggaagtttacaggaggtgagtgtgagtcattagagacattcagttctgtaggaactaacgaactcccaagaggcagtaaacttaaaactcagcagtctcgataagtatggataaattaggcaaagacagattctgaggaatttctggtgaggggtgccaagtttggggagcagcccctggctccttgcaagctacccttcagtgctctgtgtgaccaagtccaagtcgatgcaggagggcaggcactgggtcagcaagccactcagtgaatgtgcaggtgaggccgttcataggcgcttgtgtgcctcccagcaggctgcctgccattgccagggctggccttcagcagggtgcgccaccatggcctgagtggttttctgctgaagtccgtgctgatttggccagtggataggcatcacctgggtgcaaaaccattgtctccaggtaggaatgacctcagctgtttgctccgtgtctcgctcagcctgtagatgtgtccctcatcccttcatgcctccctcttcactcctcttttactttctactcggggcttgcatgtttacaagagaggtgaacccaacagaaactagtataggccaaaaggaaaatgtgctgaagctcacacagcacagtcgtgtggaaanggcagcagtgactgcttcatccagtgcccttcccacagccagtcagttgcgacccaaggggcttagggtaggagtgtttctccataggggaagagtaacagcctgcacccaccacacacccaaagccctacatcctgccacactgagacctcacttcatttgggcgggtccctcctgggttgcagtttccttcattgctcccctgtcccaaatactcaagtctctctcattaaaaataaagagcaggccaggtgcagtggctcacacctgtaatcccacactttgggaggccaaggcgggtggatcacttgagcccaggattcgagaccaacctgggcaacatgacaagatcctgtctctacaaaaaataacaaaaatcatctgggcatggaggcacacgcctgtagtcccagctacttgggaggctgaggtggaaggatcacctgagcccatgaggtggaggctacagtgagctgagatcacgccactgcactccagcctggatgacagcgagactccatctcaaaaaaaaaaaaagaaaaagaaaaagaattaattaattaattaaataaagagcatgtctcccaccccaggcctaagttcttccctctatgagagactacttgcagaaacctgtgttctcactcttcccccttcctcacttcattcccacacatttcttttccatccctgcgcaccaaggtcaccttggtgctaaacaccagggacccatggtctcttccc

SEQ ID NO: 317808 - DNA, 7086 bp, Homo sapiens
  misc_feature (6342)..(6342): n is a, c, g, or t
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcacttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatatattgtgttgaattgttcccattttctttcatacgtgtcctcatttctgggacagtgtgaatgtttctcagatctagaagtcagatggtgggagtcttagatccgaacttggttttgagtgacatgttagacaaaagtgttgaacttttgtttcttaaagaagctggatgttcatttatgtctcccgtaacagtctgtgctgtccagagacccagtatccttaggatattattctcatcctcatggttgaagctgggtcactgccatgtccataatccaccctgaggaaagagcatggagagccagcagcttcatttctaaggacaggaagccaaatctgcacttttcacttccactcataatccaccctgcattccactcatcagcttcacaagtaggttttcacctggtcatagctatgcctaactacagggagtgctggggaagtgtgatcttttgttgggggcacactgggagagtgggtctgtccactgcctcccagcctcagagcagctcaccacaggagcaggagagtgaactcgtggctgtggctgtcaggcagggcctttcttgagagccagcgcaggcctgggctcctcagaggcttctggagtgagagatggcacctcagcctggcccatggaggcatgttcagggatcagcactactgtgcttcttggaggaggtgggacttgagctggacccatgggaggctggaaatttagatgagtgaaaaggaggaaaggcgaagtagagccacattacagagggcctcagagtccagataaagcagttaacatgtagtggctccaggagggaagcctgtctgtgcaccacatacccaggatgtttgtgggaaggaaggagatgtgcggaagggacccaggagacctgcaggaggcaagggctgcaacagaccccctctggaagtttacaggaggtgagtgtgagtcattagagacattcagttctgtaggaactaacgaactcccaagaggcagtaaacttaaaactcagcagtctcgataagtatggataaattaggcaaagacagattctgaggaatttctggtgaggggtgccaagtttggggagcagcccctggctccttgcaagctacccttcagtgctctgtgtgaccaagtccaagtcgatgcaggagggcaggcactgggtcagcaagccactcagtgaatgtgcaggtgaggccgttcataggcgcttgtgtgcctcccagcaggctgcctgccattgccagggctggccttcagcagggtgcgccaccatggcctgagtggttttctgctgaagtccgtgctgatttggccagtggataggcatcacctgggtgcaaaaccattgtctccaggtaggaatgacctcagctgtttgctccgtgtctcgctcagcctgtagatgtgtccctcatcccttcatgcctccctcttcactcctcttttactttctactcggggcttgcatgtttacaagagaggtgaacccaacagaaactagtataggccaaaaggaaaatgtgctgaagctcacacagcacagtcgtgtggaaanggcagcagtgactgcttcatccagtgcccttcccacagccagtcagttgcgacccaaggggcttagggtaggagtgtttctccataggggaagagtaacagcctgcacccaccacacacccaaagccctacatcctgccacactgagacctcacttcatttgggcgggtccctcctgggttgcagtttccttcattgctcccctgtcccaaatactcaagtctctctcattaaaaataaagagcaggccaggtgcagtggctcacacctgtaatcccacactttgggaggccaaggcgggtggatcacttgagcccaggattcgagaccaacctgggcaacatgacaagatcctgtctctacaaaaaataacaaaaatcatctgggcatggaggcacacgcctgtagtcccagctacttgggaggctgaggtggaaggatcacctgagcccatgaggtggaggctacagtgagctgagatcacgccactgcactccagcctggatgacagcgagactccatctcaaaaaaaaaaaaagaaaaagaaaaagaattaattaattaattaaataaagagcatgtctcccaccccaggcctaagttcttccctctatgagagactacttgcagaaacctgtgttctcactcttcccccttcctcacttcattcccacacatttcttttccatccctgcgcaccaaggtcaccttggtgctaaacaccagggacccatggtctcttccc

SEQ ID NO: 317809 - DNA, 4775 bp, Homo sapiens
  misc_feature (4662)..(4662): n is a, c, g, or t
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcacttgaacgccggggaaggatggacngggaacctcttgtgccttagcacctccttgaacgttgtgaagcatatgcgaattttgatgtttccaaactgtcataagctttcgttcatttttttaccttttcaattattcct

SEQ ID NO: 317810 - DNA, 4758 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccagacattgaacaaattcatttaccagatactgagagcctaccatgtgccaggcattgtgcaaggtgtggggaatacagagatgaaaagagacgcagccactcccacaaggagctgtagagggaagtgagccaggtgcaagcaaagacagacagtagaccacctcctgctcactagcaaggacagaaaggcgagtgctagcaacttgaaggtaccttgcagatcaaagagataaaggtaaaagggagaaaggatactgtggcctgggcggtggtgaagcccatggctgtgtgggaatgtgaattggttctgattttctgaattagcagtctggcggatgtaagcagcattaaatatgaaaacaccccatgggagaaaaagaaaggaattggaacaa

SEQ ID NO: 317811 - DNA, 3939 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatgtgagtgatctgtgggtcaggtgagggtgg

SEQ ID NO: 317812 - DNA, 3556 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggctactaagaaaagcgaaattcataaaagagaccatgtgattctataaagcaacacagaatccgttttcagaagaggccaacgtggaccaccatacgccagtgttgcctgtgaagagagatacagttaaaaggaagaattcacggtggccccgtataggtcaaggtgtgggagtacaggaggcgactgaatgatcctccgtcca

SEQ ID NO: 317813 - DNA, 2754 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgagagatcagcatagtgcgttctttagatgactcttcagtattctggtgacc

SEQ ID NO: 317814 - DNA, 2825 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaagcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 317815 - DNA, 2849 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctagcgtcgtggctcacacctgtaatcccagcactttgggaggccgaggcgggcggatcacgaggtcaagagatcgagaccatcctggccatcatggtgaaaccccgtctctactaaaaatacaaaaaaaaaaattagccgggcgtggtggcaggcacctgtagtcccagctactcagaaggctgaggcaggagaatggcgtgaacccaggaggcggaggttgcagtgagccgagatcgcaccactgcactccagcctgggcgacagagcgagactccatctcaaaaaaaaaaaaaatttacttgtgtcttctctttttacctgtttgttaatttatcaaataactacttttggctttgtttcatttttattatacaataaaatga

SEQ ID NO: 317816 - DNA, 2140 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccagtatccctgtgcacgccagaagggtaccctacagccaggggtggcaggggaaggggctggagatgcgtctgcaggtacctggcaagcggggcttattctccaactggatccttaaccgaggaaaatacagatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaaggtgtgggtgcccagccctccacagacactctgatgtggttgttcagggcccccatgccagctccttctctctgtgccttccttctcacctcacagctgctggagtatgagccacgctcaggggagcaggtaccccttctcctaaagatgaagaggagcaaactggcactaagcaaggccatcgagagcggggacactgacctgggtgagggcaaggctggggggcccct

SEQ ID NO: 317817 - DNA, 378 bp, Homo sapiens
cccctcgcgactgcccaggaactttgcatgcgtccttctgggaccaggccagggcactgccagagttgattctcagagaagaaacttagaacggcgagaacagaatttgctcaggtccatttaatgggaggaaagaggaaaactcttggcatgagaaaatttgcttttgcagtgaccaacttttctttcccttcaagtccacctccctcggtcccccggcccgtctcccaggcccctctccttgccgccctctcccaactgttgaggctgtttaagaagggaaataagggctgagagctgcccagaattcagaataggccaattgagaacgcaggtcccctccctttttactttcggtaaataaaaaattttttttga

SEQ ID NO: 317818 - DNA, 418 bp, Homo sapiens
ctggaagaggaaattaaccggagaatggcagacgacaataagctcttcagggaggaattcaacgtgagtactttgttgaggctggtgtatcagcagggaagaaggcagacctaaagtcagacctttcagatctttggagtcatgaagtaaaaaatgggcttttaatgtttaagaggtgagaaatgttttaccaagtttatctgactccctgtatgatcatggataggaaatgaagtgagatttgcctcacctccctaatctacccatccattcagtcatcatcacatctcttacttcttttgtttaataaatacttagcaagcatctaatatttgtcaggtaatattctagttgccagtgatatgatgaggagcagaaacagatccaatccctattctcaaggaactcactgtccagg

SEQ ID NO: 317819 - DNA, 377 bp, Homo sapiens
tgtgggctggtgagaggcagggtttgtgcccttgagcagccccaacaccacctcctctcttgctcaaaccacagcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 317820 - DNA, 396 bp, Homo sapiens
aatgagctgggaactagtcactcttgttttctcacctataatagcatctgggtccagtgttttttatgtgggacaaatttgaacttgtggtcaacctctttaattgtaaggatattcaggtcttttgttcttcctgggctagttttttattctttttctagagattcgttcatttttcttagttttatttgcctataattgtggataatctgttttttatctgctacttctgtaattatttccacatttgatttataatattaacttgtgggccaggcgtcgtggctcacacctgtaatcccagcactttgggaggccgaggcgggcggatcacgaggtcaagagatcgagaccatcctggccatcatggtgaaaccccgtctctactaaaaatac

SEQ ID NO: 317821 - DNA, 615 bp, Homo sapiens
gagtgttcgcggccgctgcgcccgggtgggctccggaagggggagcggctcccgggggcggtgggaggggtcccgggccacagcccagagcccggagcccgaagccctaagccatcttttccgggtagaagcctgcgggcgcctgcaggttgattgtgcatccttgcgggtccgtcgcggggagggggtccccggaaacgtgccggcccgagtgccgacccctcgcgactgcccaggaactttgcatgcgtccttctgggaccaggccagggcactgccagagttgattctcagagaagaaacttagaacggcgagaacagaatttgctcaggtccatttaatgggaggaaagaggaaaactcttggcatgagaaaatttgcttttgcagtgaccaacttttctttcccttcaagtccacctccctcggtcccccggcccgtccttgccgccctctcccaactgttgaggctgtttaagaagggaaataagggctgagagctgcccagaattcagaataggccaattgagaacgcaggtcccctccctttttactttcggtaaataaaaaattttttttgaaaaaattagttactaattatatctcctgaagatt

SEQ ID NO: 317822 - DNA, 5416 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaaggtgtgggtgcccagccctccacagacactctgatgtggttgttcagggcccccatgccagctccttctctctgtgccttccttctcacctcacagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 317823 - DNA, 5325 bp, Homo sapiens
actgctgctgctgctgaattgcctcctgcagactctgctggtattgctggtatgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagctcgcccctggaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagaaagagagccagaaggcggacgagtacctgcgggagatccaggagctgggccagctgacccaggccgtgcagcagtgcattgaggctgcaggacatgagcaccagccagacatgcagaagagtctgctcagggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 317824 - DNA, 4318 bp, Homo sapiens
aggtttgcttgatgttacatgcaagactgttgccaatatgatcaaggggaaaactcctgaggagattcgcaagaccttcaatatcaaaaatgacttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctaaaaaaaaaaaaaaaagggcgccgctcgcgatctagctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcaggtaattctgactcgaaggacagaagagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctga

SEQ ID NO: 317825 - DNA, 5369 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccccatccccaccactgatatcatggggagtaataggaccagagcggtatctctggcaccacactagggactatcaggtaataaaagctttgactccctga

SEQ ID NO: 317826 - DNA, 5080 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattga

SEQ ID NO: 317827 - DNA, 5544 bp, Homo sapiens
  misc_feature (4800)..(4800): n is a, c, g, or t
gttcggttcggcatccgtgaacggttatctggaagccacgttcgattgggtgaaatagtaatgcctatagaatgggtgttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatatattgtgttgaattgttcccattttctttcatacgtgtcctcatttctgggacagtgtgaatgtttctcagatctagaagtcagatggtgggagtcttagatccgaacttggttttgagtgacatgttagacaaaagtgttgaacttttgtttcttaaagaagctggatgttcatttatgtctcccgtaacagtctgtgctgtccagagacccagtatccttaggatattattctcatcctcatggttgaagctgggtcactgccatgtccataatccaccctgaggaaagagcatggagagccagcagcttcatttctaaggacaggaagccaaatctgcacttttcacttccactcataatccaccctgcattccactcatcagcttcacaagtaggttttcacctggtcatagctatgcctaactacagggagtgctggggaagtgtgatcttttgttgggggcacactgggagagtgggtctgtccactgcctcccagcctcagagcagctcaccacaggagcaggagagtgaactcgtggctgtggctgtcaggcagggcctttcttgagagccagcgcaggcctgggctcctcagaggcttctggagtgagagatggcacctcagcctggcccatggaggcatgttcagggatcagcactactgtgcttcttggaggaggtgggacttgagctggacccatgggaggctggaaatttagatgagtgaaaaggaggaaaggcgaagtagagccacattacagagggcctcagagtccagataaagcagttaacatgtagtggctccaggagggaagcctgtctgtgcaccacatacccaggatgtttgtgggaaggaaggagatgtgcggaagggacccaggagacctgcaggaggcaagggctgcaacagaccccctctggaagtttacaggaggtgagtgtgagtcattagagacattcagttctgtaggaactaacgaactcccaagaggcagtaaacttaaaactcagcagtctcgataagtatggataaattaggcaaagacagattctgaggaatttctggtgaggggtgccaagtttggggagcagcccctggctccttgcaagctacccttcagtgctctgtgtgaccaagtccaagtcgatgcaggagggcaggcactgggtcagcaagccactcagtgaatgtgcaggtgaggccgttcataggcgcttgtgtgcctcccagcaggctgcctgccattgccagggctggccttcagcagggtgcgccaccatggcctgagtggttttctgctgaagtccgtgctgatttggccagtggataggcatcacctgggtgcaaaaccattgtctccaggtaggaatgacctcagctgtttgctccgtgtctcgctcagcctgtagatgtgtccctcatcccttcatgcctccctcttcactcctcttttactttctactcggggcttgcatgtttacaagagaggtgaacccaacagaaactagtataggccaaaaggaaaatgtgctgaagctcacacagcacagtcgtgtggaaanggcagcagtgactgcttcatccagtgcccttcccacagccagtcagttgcgacccaaggggcttagggtaggagtgtttctccataggggaagagtaacagcctgcacccaccacacacccaaagccctacatcctgccacactgagacctcacttcatttgggcgggtccctcctgggttgcagtttccttcattgctcccctgtcccaaatactcaagtctctctcattaaaaataaagagcaggccaggtgcagtggctcacacctgtaatcccacactttgggaggccaaggcgggtggatcacttgagcccaggattcgagaccaacctgggcaacatgacaagatcctgtctctacaaaaaataacaaaaatcatctgggcatggaggcacacgcctgtagtcccagctacttgggaggctgaggtggaaggatcacctgagcccatgaggtggaggctacagtgagctgagatcacgccactgcactccagcctggatgacagcgagactccatctcaaaaaaaaaaaaagaaaaagaaaaagaattaattaattaattaaataaagagcatgtctcccaccccaggcctaagttcttccctctatgagagactacttgcagaaacctgtgttctcactcttcccccttcctcacttcattcccacacatttcttttccatccctgcgcaccaaggtcaccttggtgctaaacaccagggacccatggtctcttccc

SEQ ID NO: 317828 - DNA, 3129 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttcacagtgcttgtcttacacagtccagcctaagcaaaggcaagctcaagacaggatcctccagacaccacagcaaaactccatgtgttccgttgtgttgggaccggaggtgggggcttctccagccatactcgcaagaaacgtgtcctctccacagttaccaaggaaagctttctctatctcacagctcctaggaagattatagggagagatggcacaaaacttaagcaccagctcaccaagaacatactgtaaagcattctgtgtgtgtgcgtgtaaacacgc

SEQ ID NO: 317829 - DNA, 2862 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggttcagctttttctccagggccatggcagctttcttaactatcctaacaagccttg

SEQ ID NO: 317830 - DNA, 2967 bp, Homo sapiens
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagataagcatggattcctggttcattcttgttctgctcggcagtggtctgactatgtgtcagtgccacaatgctaccacact

SEQ ID NO: 317831 - DNA, 944 bp, Homo sapiens
actgctgctgctgctgaattgcctcctgcagactctgctggtattgctggtatgctgcagtagggagcctggggacagccccatcagggcctgcgacagtgcagggctgtaggggaacaggccttccatgccatacataggctgcaggtacccgctctgcagggcgccagggatctggggagcataataaggagaaaagcctggtacaaagtaaggaaggaactggcttgtgagcaatgctgtggggtccgaagtcaacgcggcctgcagggcctgcagctgtgcagggtctaccgcatactccatggtgggcagctcgcccctggaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgcccctgagttgatcgccaaggccgtgaacgagaagtcctgcagctcgcccactgagttaactcaggggcgagctgcaccgtagtcctagcctcctataaggcccaggaagagggcagaggccagaagactccatggcccaaaaccctcctcctaccggg

SEQ ID NO: 317832 - DNA, 345 bp, Homo sapiens
gcctgcggctacagaggccacacatggtccagacactggtatgctgcccacatatttgtccctgccaccacaccacctgcagcccttctctcagggaggaggctcttcagaggggcccacccagtagtcagaagactgtctaaacacagacctgcccttgccctcccaaggtgccccaaatacacaggaaacattgggaggcaggatggcagcaatgggagcatagcccctgttgccagaggttgggccaggttagaaggggtgtctgggtgccccacagggctcatctgtacttctctgtgggtcttgggtaaggaagatccatgaagagtacctgcctttggg

SEQ ID NO: 317833 - DNA, 496 bp, Homo sapiens
tcccacagccagtcagttgcgacccaaggggcttagggtaggagtgtttctccataggggaagagtaacagcctgcacccaccacacacccaaagccctacatcctgccacactgagacctcacttcatttgggcgggtccctcctgggttgcagtttccttcattgctcccctgtcccaaatactcaagtctctctcattaaaaataaagagcaggccaggtgcagtggctcacacctgtaatcccacactttgggaggccaaggcgggtggatcacttgagcccaggattcgagaccaacctgggcaacatgacaagatcctgtctctacaaaaaataacaaaaatcatctgggcatggaggcacacgcctgtagtcccagctacttgggaggctgaggtggaaggatcacctgagcccatgaggtggaggctacagtgagctgtgatcatgccactgcactccagcctgggtcaaagagtgagaccctgtctc

SEQ ID NO: 317834 - DNA, 8108 bp, Homo sapiens
  misc_feature (7364)..(7364): n is a, c, g, or t
gcggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggtgacacaactaaaaaaaaacaaaggtatttatggaattccactgagtggtaatggatgatgcagttcaaataactaaggacacatgttcaaagagcataattaactttttaaaagaagctaataagcatggattcctggttcattcttgttctgctcggcagtggtctgatatgtgtcagtgccaacaatgctaccacagttgcaccttctgtaggaattacaagattaattaactcatcaacggcagaaccagttaaagaagaggccaaaacttcaaatccaacttcttcactaacttctctttctgtggcaccaacattcagcccaaatataactctgggacccacctatttaaccactgtcaattcttcagactctgacaatgggaccacaagaacagcaagcaccaattctataggcattacaatttcaccaaatggaacgtggcttccagataaccagttcacggatgccagaacagaaccctgggaggggaattccagcaccgcagcaaccactccagaaactttccctccttcagatgagacaccaattattgcggtgatggtggccctgtcctctctgctagtgatcgtgtttattatcatagttttgtacatgttaaggtttaagaaatacaagcaagctgggagccattccaattctttccgcttatccaacggccgcactgaggatgtggagccccagagtgtgccacttctggccagatccccaagcaccaacaggaaatacccacccctgcccgtggacaagctggaagaggaaattaaccggagaatggcagacgacaataagctcttcagggaggaattcaacgctctccctgcatgtcctatccaggccacctgtgaggctgcttccaaggaggaaaacaaggaaaaaaatcgatatgtaaacatcttgccttatgaccactctagagtccacctgacaccggttgaaggggttccagattctgattacatcaatgcttcattcatcaacggttaccaagaaaagaacaaattcattgctgcacaaggaccaaaagaagaaacggtgaatgatttctggcggatgatctgggaacaaaacacagccaccatcgtcatggttaccaacctgaaggagagaaaggagtgcaagtgcgcccagtactggccagaccaaggctgctggacctatgggaatattcgggtgtctgtagaggatgtgactgtcctggtggactacacagtacggaagttctgcatccagcaggtgggcgacatgaccaacagaaagccacagcgcctcatcactcagttccactttaccagctggccagactttggggtgccttttaccccgatcggcatgctcaagttcctcaagaaggtgaaggcctgtaaccctcagtatgcaggggccatcgtggtccactgcagtgcaggtgtagggcgtacaggtacctttgtcgtcattgatgccatgctggacatgatgcatacagaacggaaggtggacgtgtatggctttgtgagccggatccgggcacagcgctgccagatggtgcaaaccgatatgcagtatgtcttcatataccaagcccttctggagcattatctctatggagatacagaactggaagtgacctctctagaaacccacctgcagaaaatttacaacaaaatcccagggaccagcaacaatggattagaggaggagtttaagaagttaacatcaatcaaaatccagaatgacaagatgcggactggaaaccttccagccaacatgaagaagaaccgtgttttacagatcattccatatgaattcaacagagtgatcattccagttaagcggggcgaagagaatacagactatgtgaacgcatcctttattgatggctaccggcagaaggactcctatatcgccagccagggccctcttctccacacaattgaggacttctggcgaatgatctgggagtggaaatcctgctctatcgtgatgctaacagaactggaggagagaggccaggagaagtgtgcccagtactggccatctgatggactggtgtcctatggagatattacagtggaactgaagaaggaggaggaatgtgagagctacaccgtccgagacctcctggtcaccaacaccagggagaataagagccggcagatccggcagttccacttccatggctggcctgaagtgggcatccccagtgacggaaagggcatgatcagcatcatcgccgccgtgcagaagcagcagcagcagtcagggaaccaccccatcaccgtgcactgcagcgccggggcaggaaggacggggaccttctgtgccctgagcaccgtcctggagcgtgtgaaagcagaggggattttggatgtcttccagactgtcaagagcctgcggctacagaggccacacatggtccagacactggaacagtatgagttctgctacaaggtggtgcaggagtatattgatgcattctcagattatgccaacttcaagtaagcggcaacaagggtccgtggaccaggaggattgcctttaatattttgtaatattctgttttgttaatataccccaaattgtgtatatatcttataactgttttagaaattggtacataggcttctattacctattaggtggaaattttatatgtaaatgtgttagcactgatagtcctttttccaatgttttattggggaattaaatagtgtgatgtttggattgatatcgtgaaatcctcagccgagaaattgggctggattgtgctttggttaatacatctttccctaaagaagataaacacaaaatccattccaggtagctcggcaccaactaagaaaaaaagcacaaagttctcagagctctcgaggaaagtggttgtccccgtaccaccatgcactgtaaatatccctcccctctctccctggtcccctcccccatccccaccactgatatcatggggagtaataggaccagagcggtatctctggcaccacactagggactatcaggtaataaaagctttgactccctgaggaaatgtctctccctttgtctgggggtggggcagccatacaggctggggctctcctcggctgttcatggccctcctgttgctgttctctctgagttatctgagagaggccacagtcccccagctcctcctgtccaccaaacacagcccttccagttcttaggtgatctccaggaccctcctttcattcccagcacatctttggtttagtggtcctggccagcctccctccctaggaaggtggccaggtcctcactgagtctccttaaggacaggggcacaggggagactagagctggctcagctttgggctgaggccagtctgacctctccagtctgtggtgctttgctacaaaactgtctggattgtgtcaccctatctaggataaatctttatgtccacatatattgtgttgaattgttcccattttctttcatacgtgtcctcatttctgggacagtgtgaatgtttctcagatctagaagtcagatggtgggagtcttagatccgaacttggttttgagtgacatgttagacaaaagtgttgaacttttgtttcttaaagaagctggatgttcatttatgtctcccgtaacagtctgtgctgtccagagacccagtatccttaggatattattctcatcctcatggttgaagctgggtcactgccatgtccataatccaccctgaggaaagagcatggagagccagcagcttcatttctaaggacaggaagccaaatctgcacttttcacttccactcataatccaccctgcattccactcatcagcttcacaagtaggttttcacctggtcatagctatgcctaactacagggagtgctggggaagtgtgatcttttgttgggggcacactgggagagtgggtctgtccactgcctcccagcctcagagcagctcaccacaggagcaggagagtgaactcgtggctgtggctgtcaggcagggcctttcttgagagccagcgcaggcctgggctcctcagaggcttctggagtgagagatggcacctcagcctggcccatggaggcatgttcagggatcagcactactgtgcttcttggaggaggtgggacttgagctggacccatgggaggctggaaatttagatgagtgaaaaggaggaaaggcgaagtagagccacattacagagggcctcagagtccagataaagcagttaacatgtagtggctccaggagggaagcctgtctgtgcaccacatacccaggatgtttgtgggaaggaaggagatgtgcggaagggacccaggagacctgcaggaggcaagggctgcaacagaccccctctggaagtttacaggaggtgagtgtgagtcattagagacattcagttctgtaggaactaacgaactcccaagaggcagtaaacttaaaactcagcagtctcgataagtatggataaattaggcaaagacagattctgaggaatttctggtgaggggtgccaagtttggggagcagcccctggctccttgcaagctacccttcagtgctctgtgtgaccaagtccaagtcgatgcaggagggcaggcactgggtcagcaagccactcagtgaatgtgcaggtgaggccgttcataggcgcttgtgtgcctcccagcaggctgcctgccattgccagggctggccttcagcagggtgcgccaccatggcctgagtggttttctgctgaagtccgtgctgatttggccagtggataggcatcacctgggtgcaaaaccattgtctccaggtaggaatgacctcagctgtttgctccgtgtctcgctcagcctgtagatgtgtccctcatcccttcatgcctccctcttcactcctcttttactttctactcggggcttgcatgtttacaagagaggtgaacccaacagaaactagtataggccaaaaggaaaatgtgctgaagctcacacagcacagtcgtgtggaaanggcagcagtgactgcttcatccagtgcccttcccacagccagtcagttgcgacccaaggggcttagggtaggagtgtttctccataggggaagagtaacagcctgcacccaccacacacccaaagccctacatcctgccacactgagacctcacttcatttgggcgggtccctcctgggttgcagtttccttcattgctcccctgtcccaaatactcaagtctctctcattaaaaataaagagcaggccaggtgcagtggctcacacctgtaatcccacactttgggaggccaaggcgggtggatcacttgagcccaggattcgagaccaacctgggcaacatgacaagatcctgtctctacaaaaaataacaaaaatcatctgggcatggaggcacacgcctgtagtcccagctacttgggaggctgaggtggaaggatcacctgagcccatgaggtggaggctacagtgagctgagatcacgccactgcactccagcctggatgacagcgagactccatctcaaaaaaaaaaaaagaaaaagaaaaagaattaattaattaattaaataaagagcatgtctcccaccccaggcctaagttcttccctctatgagagactacttgcagaaacctgtgttctcactcttcccccttcctcacttcattcccacacatttcttttccatccctgcgcaccaaggtcaccttggtgctaaacaccagggacccatggtctcttccc

SEQ ID NO: 317835 - DNA, 624 bp, Homo sapiens
catgcctcagcctcctgagtagctgggattacaggtgtgtgccaccacatggtatttttagtagagatgggttttgtcatgttggccagactggtctggaactcctggcctcccaaagtgctgggattacaggtgtgagccactgcacctggcctcagagtttcttttgaaaaggctctttgggagtctaagcttctcgtacttgacagtgttgaggatgatggtggcttagattccctggctggaagtgcttcatgaccatggtaaccattccctctcttttcttgcttttgcaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagatt

SEQ ID NO: 317836 - DNA, 728 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgagggtaaggaagtgggtggctacagtgctccaactcatgatcctgtgcttccgtttcattttccagccccagtacttctttgcattacttatatctatatagattattctctttgaca

SEQ ID NO: 317837 - DNA, 7155 bp, Homo sapiens
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317838 - DNA, 7203 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317839 - DNA, 7017 bp, Homo sapiens
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatgtaagaaagaacccacactctatgatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317840 - DNA, 7365 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317841 - DNA, 7434 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317842 - DNA, 6894 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317843 - DNA, 7176 bp, Homo sapiens
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacacctaaaaaaaaaaaaaagaaaaaaa

SEQ ID NO: 317844 - DNA, 7972 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtggattgtgcaggatcagttttacttatttcagacttgaatgagatctttctattaaaaatatgtggttgagaggcctgcagtcttttctgcgagggcccctcacagagttgaggaattataaggaatgacctaaaccccagacatacttgttcccttccattggtatcgtctgctttccctgtataaagtctcaagtgagtaaaaccttttttctgttgttccagccatacacttggtgtacagtcagccttacaaaattatgcagaacaaagtatagttcttatttaatgaaatttccttctaaggaaactgatgctttaaaaaaaatacaaaagaaagaaaagcctttttatctctttcttggcattaacctttacttattcttcgtgagttcagcatttacaatactggcttttagactaagtttttaggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317845 - DNA, 5424 bp, Homo sapiens
gagagtattctctcagagcctgctttccactgggacctagttgttcctagactattccgtgaccccatgagcacttactatgtagttctcgtggattcagcagcaggtcgccttgtgtttccccttctcttcgttggtgtgtgcatatgtcagtgcttcccccagcaccccagcgtgtactttattttttccttttgatttgaggatatatgatccaggggaaatttcagtttggtataactactttaattagccataattattcattctaagtttttgctcagaaacaaatggcactggaaagaaattctttgttaaagggagaaagctaagcagttgcttttttggaggaggctttatatcggtagcctcatctcatgttttgattttgagaaggcgaaaagcctaaacaggatctccttgactccagagattaaggcctttcacgtctggattttttctccataggtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317846 - DNA, 5275 bp, Homo sapiens
  misc_feature (5187)..(5187): n is a, c, g, or t
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggccaagaactcagtcatttttntgtgtaccaggttgcctaaatcatgtgcagatggttctaaaaaaaaaaaaaaaaaaaaaaaaagggaaaaaaaaaaaaaagaaaaaaa

SEQ ID NO: 317847 - DNA, 6502 bp, Homo sapiens
  misc_feature (5007)..(5007): n is a, c, g, or t
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattttgtttttttggatttggggtgggggtcctggccaagaactcagtcatttttntgtgtaccaggttgcctaaatcatgtgcagatggttctaaaaaaaaaaaaaaaaaaaaaaaaagggagaaaaacaaaaaagagaaaaaagaaaacggtgggtcgattttgggggttaatgtgggcgcagagaacttttggccggtggtggaccaggttttaggaacttggcgctcaaggtaacaagagtgtagaatttgttgtggtgttatacccttaggaactgtgacaaacaaaagtgttttcacccacaaggtctgggcgatttggggagaaaaggaaacgagaacaaaattttcacacacgccacatgtgtgttttatattttcttttttggacgcatacacccactcatatggtgtgctctaaaagcggcgtattggaaagagggggggattgaacaggttcaatatatgtgtggtttcggggcgagagaaaacaccccattataactgtggctgtataacatttataactctctgtttatatattcccccgaaaaagacgcgacgccaagtagatttttgcgagacgtgtttgggggacaggttctctatatgtgtgggtgcaccacaaatttcgagcgacgaggggcgacacaaagagaaacctgtgggcgccccatgttagaaagaggatttggggagacaaataatagcggccttataaaagggggggggagagatgtgccggcgaatctcttaacttctcacccagagtttttttaagaaaaacaaccccgagaaatgtgtgcgctgcttggtggtttgttcaacacgccgagagatttttttccccccaaatttttgaggagacgggtgtgtgagcggggggggcaccaaagtgtgggcttggccccagatgttaaaaccacaagaagagatttctatccaagtgggggtccccgccgaaaagtgattaacagagggggcggtttgttgatcgatcaccaccaaagcaccaagcggggtggggccgtggtcaccccacctgttagcacaaaatatagtgttctccgaacaaacaaacagctggtgctaccaacgagtgggttttgtggcgaagaggagaacaccactctttttatgtccgtgtggaggggagggaggggaggggggaggacattttcccccctcctgtttgtttctcataagaaaaacgtgtggcataagtggtgccaactataaaaaacgccagatttattgttttcagagacagcacgtgtgtgggtttgcttcacaagctaccgcggccggatataagtcaccacataagaaacggggggggcagaactcactacgcagggaggtgctctaacgaagggggcttgaacaacactctcgcgagagcagctcatgggcggacgttcactaccggcgggtatgtcagcaaacgcagttgtgggccaccgtccttggatgtcaccccaggggaggttgttttcagacagccccaagttttttaccactttattatagaggacgtaccttctgtcg

SEQ ID NO: 317848 - DNA, 3860 bp, Homo sapiens
ttctagaggatcccgaaatgttatcgcccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317849 - DNA, 3820 bp, Homo sapiens
catgcctcagcctcctgagtagctgggattacaggtgtgtgccaccacatggtatttttagtagagatgggttttgtcatgttggccagactggtctggaactcctggcctcccaaagtgctgggattacaggtgtgagccactgcacctggcctcagagtttcttttgaaaaggctctttgggagtctaagcttctcgtacttgacagtgttgaggatgatggtggcttagattccctggctggaagtgcttcatgaccatggtaaccattccctctcttttcttgcttttgcaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317850 - DNA, 4776 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtggattgtgcaggatcagttttacttatttcagacttgaatgagatctttctattaaaaatatgtggttgagaggcctgcagtcttttctgcgagggcccctcacagagttgaggaattataaggaatgacctaaaccccagacatacttgttcccttccattggtatcgtctgctttccctgtataaagtctcaagtgagtaaaaccttttttctgttgttccagccatacacttggtgtacagtcagccttacaaaattatgcagaacaaagtatagttcttatttaatgaaatttccttctaaggaaactgatgctttaaaaaaaatacaaaagaaagaaaagcctttttatctctttcttggcattaacctttacttattcttcgtgagttcagcatttacaatactggcttttagactaagtttttaggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagatt

SEQ ID NO: 317851 - DNA, 3165 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtggattgtgcaggatcagttttacttatttcagacttgaatgagatctttctattaaaaatatgtggttgagaggcctgcagtcttttctgcgagggcccctcacagagttgaggaattataaggaatgacctaaaccccagacatacttgttcccttccattggtatcgtctgctttccctgtataaagtctcaagtgagtaaaaccttttttctgttgttccagccatacacttggtgtacagtcagccttacaaaattatgcagaacaaagtatagttcttatttaatgaaatttccttctaaggaaactgatgctttaaaaaaaatacaaaagaaagaaaagcctttttatctctttcttggcattaacctttacttattcttcgtgagttcagcatttacaatactggcttttagactaagtttttaggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccaggtacccgtgtcttctctgttgtcagagg

SEQ ID NO: 317852 - DNA, 1772 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagaggagtcctcctcctgctgctccgttatgagaaatgcatcacccaagcaattacagcattcatttggtcaaacgcgcccttctacattctcctccgtatcagcagaactgaaagcctgtacactacatttcccagactcctttgccagctggcttccacagttaggttttcaaaggctggagattggttggcaagtggaaggataacaccacttttttcctgttactgctctgtcttggggagcagcagcagcaggagcagtgaacaactatggaagaatgcaggcaactacaca

SEQ ID NO: 317853 - DNA, 1381 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaaccgtggactagtagccaaccgtggactagtagccaaccgtggactagtagcccacgtggactagta

SEQ ID NO: 317854 - DNA, 1226 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagccggggaggagggtttctgggaatgagaaacagtgctctcattggatgcatgtcacaga

SEQ ID NO: 317855 - DNA, 228 bp, Homo sapiens
taaggaaactgatgctttaaaaaaaatacaaaagaaagaaaagcctttttatctctttcttggcattaacctttacttattcttcgtgagttcagcatttacaatactggcttttagactaagtttttaaaaatcaccttcttaaactcactggttgcctaccttctgctttttggtacctggggtgatagttgtgactgcttctcacccttctcttttaatccctct

SEQ ID NO: 317856 - DNA, 469 bp, Homo sapiens
ccatgaacctcacctcattagtgtccacctggcactgactgatcagcacactataacatcatgagaaagatggcgggaagatccctggtaattatacatttttacttacgtagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggttagttcacagataacatagcaggcatacacttgtgaagtttgttactttgcagagctgggggatttttagaaagtatacacacatgtgatgcatacacacatgtacacacatacacatatacttagaacttcagatgtatgaacgtggtgaaacacagttggaatgacaccaataaattcagtctcttgtct

SEQ ID NO: 317857 - DNA, 434 bp, Homo sapiens
ggattatgactcccttgtcagctgtttctgtggtacacatctccaacttgtgacttgcctttcactaggtttaagtgctggccttaagtgattgatttcttttggttactattgttattaatgatgagacctacttctggatatgcatgtaaaatatttatatttattttgctaggcaaaaaggataagttacgtgtctactatttgtcctggttaagaaataaaatacttcacaatgatccagaagttgagaagaagcagggatggacaaccgtaggggatttggaaggatgtgtacattataaagttggtaagttctagaagcgtcatattttgtttttccagagtttgattagagtttgaattttaaactttaaattttcacaggttttttgaagtttgtaataataaacttgtttctgaaacacgtggat

SEQ ID NO: 317858 - DNA, 412 bp, Homo sapiens
ccttttctctccaactgccttgcttgatttattcatttttttggcttcttttaaatgataacccctcccctccttcctctccaggatcctgctgggatttttgagctggtggaagtggttggaaatggcacctatggacaagtctataaggtcggtgtgggcgccttctttgtttcccgtggcatgtggaaacttcttattgggggacgaggagagggtgataaacatgctgctgactggaggccacgccgcttggccaaagttgggagaggggtttctttcgccttgcagtccctctgtttttgcacaccgagtttatattcagactggccttaaaagacctcatttcctggctttgagataaggaaataagctacactcttaggcatgcactttacttcgataaaatgga

SEQ ID NO: 317859 - DNA, 584 bp, Homo sapiens
aggatcccgtggatgttatcgccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttggggtgttggggataacatcacgtaatcctctagggtca

SEQ ID NO: 317860 - DNA, 7596 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggtacagtggtcccacctggcatctctcaagaacaatgtttcccctgtctcgcgatcccattccttcagtgacccttctcccaaatttgcacaccaccatcttcgttctcaggacccatgtccaccttcccgcagtgaggtgctcagtcagagctctgactctaagtcagaggcgcctgaccctacccaaaaggcttggtctagatcagacagtgacgaggtgcctccaagggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317861 - DNA, 6241 bp, Homo sapiens
ccgggtgcttcatagctttcgcgtctacttactggtccggattgcctcgtacttactgccggcttgcctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactggagtgccgatggcgggagatggaggagcaccggcaggcagagaggctccagaggcagttgcaacaagaacaagcatatctcctgtctctacagcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317862 - DNA, 6840 bp, Homo sapiens
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317863 - DNA, 7302 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317864 - DNA, 5268 bp, Homo sapiens
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggtggaagatagatttaggaaaactaaccacagctcccctgaagcccagtctaagcagacaggcagagtattggagccaccagtgccttcccgatcagagtctttttccaatggcaactccgagtctgtgcatcccgccctgcagagaccagcggagccacaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaaga

SEQ ID NO: 317865 - DNA, 5199 bp, Homo sapiens
ttcaatttctacacagtgaaaccatacctgtactaaaaaggaagttttcagacccctcaagcctgctgatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317866 - DNA, 3854 bp, Homo sapiens
aggatcccgtggatgttatcgccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattctaccatcaggtgctataagtgtttgggattgagcatcatactggaaagcaaacacctttcctccagctccagaattccttgtctctgaatgactctgtcttgtgggtgtctgacagtggcgacgatgaacatgccgttggttttattggcagtgggcacaaggaggtgagaagtggtggtaaaaggagcggagtgctgaagcagagagcagatttaatatagtaacattaacagtgtatttaattgacatttcttttttgtaatgtgacgatatgtggacaaagaagaagatgcaggtttaagaagttaatatttataaaatgtgaaagacacagttactaggataacttttttgtgggtggggcttgggagatggggtggggtgggttaaggggtcccattttgtttctttggatttggggtgggggtcctggccaagaactcagtcatttttctgtgtaccaggttgcctaaatcatgtgcagatggttctaaaaaaaaaaaaaaaaaaaaaaaaaaaggaaaaaaaaaaagaaaaagaaaacgtgtgcattttgtataatggccagaactttgtcgtgtgacagtattagcactgcctcagttaaaggtttaatttttgtttaaacctagacgtgcaacaaaagttttaccacagtctgcacttgcagaagaaagaaaaaaattcaaaccacatgtttattttttttttgcctacctcattgttcttaatgcattgagaggtgatttagtttatatgtttttggaagaaaccattaatgtttaatttaatcttaataccaaaacgaccagattgaagtttgacttttattgtcacaaatcagcaggcacaagaactgtccatgaagatgggaaatagccttaaggctgatgcagtttacttacaagtttagaaaccagaatgctttgtttttaccagattcaccattagaggttgatggggcaactgcagcccatgacacaagatctcattgttctcgatgtagaggggttggtagcagacaggtggttacattagaatagtcacacaaactgttcagtgttgcaggaaccttttcttgggggtgggggagtttcccttttctaaaaatgcaatgcactaaaactattttaagaatgtagttaattctgcttattcataaagtgggcatcttctgtgttttaggtgtaatatcgaagtcctggcttttctcgttttctcacttgctctcttgttctctgtttttttaaaccaattttactttatgaatatattcatgacatttgtaataaatgtcttgagaaagaatttgtttcatggcttcatggtcatcactcaagctcccgtaaggatattaccgtctcaggaaaggatcaggactccatgtcacagtcctgccatcttactttcctcttgtcgagttctgagtggaaataactgcattatggctgctttaacctcagtcatcaaaagaaacttgctgttttttaggcttgatctttttcctttgtggttaattttcctgtatattgtgaaaatgggggattttccctctgctcccacccacctaaacacagcagccatttgtacctgtttgcttcccatcccacttggcacccactctgacctcttgtcagtttcctgttcctggttccatctttttgaaaaaggccctcctttgagctacaaacatctggtaagacaagtacatccactcatgaatgcagacacagcagctggtggttttgtgtatacctgtaaagacaagctgagaagcttactttttggggaagtaaaagaagatggaaatggatgtttcatttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgtacatatcaagagaagaaggaaaggcacaggtggagaacagtaaaaggtgggcagatgtctttgaagaaatgctcaatgtctgatgctaagtgggagaaggcagagaacaaaggatgtggcataatggtcttaacattatccaaagacttgaagctccatgtctgtaagtcaaatgttacacaaaaaaaaatgcaaatggtgtttcattggaattaccaagtgcttagaacttgctggctttcccataggtggtaaaggggtctgagctcacaccgagttgtgcttggcttgcttgtgcagctccaggcacccggtgggcactctggtggtgtttgtggtgaactgaattgaatccattgttgggcttaagttactgaaattggaacaccctttgtccttctcggcgggggcttcctggtctgtgctttacttggcttttttccttcccgtcttagcctcacccccttgtcaaccagattgagttgctatagcttgatgcagggacccagtgaagtttctccgttaaagattgggagtcgtcgaaatgtttagattcttttaggaaaggaattattttccccccttttacagggtagtaacttctccacagaagtgccaatatggcaaaattacacaagaaaacagtattgcaatgacaccattacataaggaacattgaactgttagaggagtgctcttccaaacaaaacaaaaatgtctctaggtttagtcagagctttcacaagtaataacctttctgtattaaaatcagagtaaccctttctgtattgagtgcagtgttttttactcttttctcatgcacatgttacgttggagaaaatgtttacaaaaatggttttgttacactaatgcgcaccacatatttatggtttattttaagtgactttttatgggttatttaggttttcgtcttagttgtagcacacttaccctaattttgccaattattaatttgctaaatagtaatacaaatgacaaactgcattaaatttactaattataaaagctgcaaagcagactggtggcaagtacacagcccttttttttgcagtgctaacttgtctactgtgtattatgaaaattactgttgtccccccacccttttttccttaaataaagtaaaaatgacaccta

SEQ ID NO: 317867 - DNA, 4702 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagcgaaggagagaacaagaagaaaagaggcgtctagaggagttggagagaaggcgcaaagaagaagaggagaggagacgggcagaagaagaaaagaggagagttgaaagagaacaggagtatatcaggcgacagctagaagaggagcagcggcacttggaagtccttcagcagcagctgctccaggagcaggccatgttactgcatgaccataggaggccgcacccgcagcactcgcagcagccgccaccaccgcagcaggaaaggagcaagccaagcttccatgctcccgagcccaaagcccactacgagcctgctgaccgagcgcgagaggttcctgtgagaacaacatctcgctcccctgttctgtcccgtcgagattccccactgcagggcagtgggcagcagaatagccaggcaggacagagaaactccaccagcagtattgagcccaggcttctgtgggagagagtggagaagctggtgcccagacctggcagtggcagctcctcagggtccagcaactcaggatcccagcccgggtctcaccctgggtctcagagtggctccggggaacgcttcagagtgagatcatcatccaagtctgaaggctctccatctcagcgcctggaaaatgcagtgaaaaaacctgaagataaaaaggaagttttcagacccctcaagcctgctgcaagtggattgtgcaggatcagttttacttatttcagacttgaatgagatctttctattaaaaatatgtggttgagaggcctgcagtcttttctgcgagggcccctcacagagttgaggaattataaggaatgacctaaaccccagacatacttgttcccttccattggtatcgtctgctttccctgtataaagtctcaagtgagtaaaaccttttttctgttgttccagccatacacttggtgtacagtcagccttacaaaattatgcagaacaaagtatagttcttatttaatgaaatttccttctaaggaaactgatgctttaaaaaaaatacaaaagaaagaaaagcctttttatctctttcttggcattaacctttacttattcttcgtgagttcagcatttacaatactggcttttagactaagtttttaggtgatagttgtgactgcttctcacccttctcttttaatccctctgatgttacctgaccatgtaattgtgcacgctttgtggaattttaagcctgtcagagttttcatttcctgcttgaactgatttctgtacttctccctctccccttctttctcccgcgcttccttgtactgtgcattcctcatcaacgatggcttctcggactccacgaaactgcgctgtactgaagggcgaagtggatctgaccgcactggccaaagagcttcgagcagtggaagatgtacggccacctcacaaagtaacggactactcctcatccagtgaggagtcggggacgacggatgaggaggacgacgatgtggagcaggaaggggctgacgagtccacctcaggaccagaggacaccagagcagcgtcatctctgaatttgagcaatggtgaaacggaatctgtgaaaaccatgattgtccatgatgatgtagaaagtgagccggccatgaccccatccaaggagggcactctaatcgtccgccagagtacagttgaccaaaagcgtgccagccatcatgagagcaatggctttgccggtcgcattcacctcttgccagatctcttacagcaaagccattcctcctccacttcctccacctcctcctccccatcctccagccagccgacacccaccatgtccccacagacaccccaggacaagctcactgctaatgagactcagtccgctagtagcacactccagaaacacaaatcttcctcctcctttacaccttttatagaccccagattactacagatttctccatctagcggaacaacagtgacatctgtggtgggattttcctgtgatgggatgagaccagaagccataaggcaagatcctacccggaaaggctcagtggtcaatgtgaatcctaccaacactaggccacagagtgacaccccggagattcgtaaatacaagaagaggtttaactctgagattctgtgtgctgccttatggggagtgaatttgctagtgggtacagagagtggcctgatgctgctggacagaagtggccaagggaaggtctatcctcttatcaaccgaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagggatggacaaccgtaggggatttggaaggatgtgtacattataaagttgtaaaatatgaaagaatcaaatttctggtgattgctttgaagagttctgtggaagtctatgcgtgggcaccaaagccatatcacaaatttatggcctttaagtcatttggagaattggtacataagccattactggtggatctcactgttgaggaaggccagaggttgaaagtgatctatggatcctgtgctggattccatgctgttgatgtggattcaggatcagtctatgacatttatctaccaacacatatccagtgtagcatcaaaccccatgcaatcatcatcctccccaatacagatggaatggagcttctggtgtgctatgaagatgagggggtttatgtaaacacatatggaaggatcaccaaggatgtagttctacagtggggagagatgcctacatcagtagcatatattcgatccaatcagacaatgggctggggagagaaggccatagagatccgatctgtggaaactggtcacttggatggtgtgttcatgcacaaaagggctcaaagactaaaattcttgtgtgaacgcaatgacaaggtgttctttgcctctgttcggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttggggtgttggggataacatcacgtaatcctctagggtca

SEQ ID NO: 317868 - DNA, 1562 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaagagcaacaaaggagagagcgggaagctagaaggcagcaggaacgtgaacagttgaaggccaaggaagagtcggaggagtcggacgaggatatgggatttggtctctaatactactcaccaataaggaatcggcaaa

SEQ ID NO: 317869 - DNA, 1384 bp, Homo sapiens
caaacttttagatactgtaaatattgcattaaaaattgtataactgcttaaaaataccattttttattcacattagacccagttaatataaaatataatagtttgaggatcataatgtgaaaagtagaatgtttttgaggtaaaatgaaaaagaatgttagggaatatttgagtcagatatttgataattgggtagtgatgaagagcaaagtggtcctcctgtgcccatgtgcttctgagagagaatgagcacttcagaattgctgcacttgggtgtgccgtagaataccagacactgtcagtcttctggaccaaatatatggagcgaatacactggactatgaaatgagctttcagttatttaggtgcctccaaattattatgaattattgaggagcatcacgtttctaggtctttagaaaagagagggcatggcggttaaactggttttcccaatttctccaagatatgttgctcaccttgtgtcttgtctgccctatagcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttgttgactttggtgtgagtgctcagctggacaggactgtggggcggagaaatacgttcataggcactccctactggatggctcctgaggtcatcgcctgtgatgagaacccagatgccacctatgattacagaagtgatctttggtcttgtggcattacagccattgagatggcagaaggtgctccccctctctgtgacatgcatccaatgagagcactgtttctcattcccagaaaccctcctccccggctgaagtcaaaaaaatggtcgaagaagttttttagttttatagaagggtgcctggtgaagaattacatgcagcggccctctacagagcagcttttgaaacatccttttataagggatcagccaaatgaaaggcaagttagaatccagcttaaggatcatatagatcgtaccaggaagaagagaggcgagaaagatgaaactgagtatgagtacagtgggagtgaggaagaagaggaggaagtgcctgaacaggaaggagagccaagtgccattatgaacgtgcctgttgagtctactattccacgtagatctcagtggagcatggcagcaggaggactacgaacgtgcccacgagattcgaacaatgcacgacattcatgagcgaccgagcacggatctcaggaataatatcaagctgtgtgctgagtgaaa

SEQ ID NO: 317870 - DNA, 749 bp, Homo sapiens
aattcgaggatccgggtaccatggcacagagcgacagagacatttattgttatttgttttttggtggcaaaaagggaaaatggcgaacgactcccctgcaaaaagtctggtggacatcgacctctcctccctgcgggatcctgctgggatttttgagctggtggaagtggttggaaatggcacctatggacaagtctataagggtcgacatgttaaaacgggtcagttggcagccatcaaagttatggatgtcactgaggatgaagaggaagaaatcaaactggagataaatatgctaaagaaatactctcatcacagaaacattgcaacatattatggtgctttcatcaaaaagagccctccaggacatgatgaccaactctggcttgttatggagttctgtggggctgggtccattacagaccttgtgaagaacaccaaagggaacacactcaaagaagactggatcgcttacatctccagagaaatcctgaggggactggcacatcttcacattcatcatgtgattcaccgggatatcaagggccagaatgtgttgctgactgagaatgcagaggtgaaacttggtatgtaatggatgtgcggcgtgatctcataattgcacctggcacaagccagctgcactcccagttctgcttccatctagctaaaagttcagtcttacccatgttttctatttctgttcttcttaagaatgtgggaactgagcatattacttagcttggctc

SEQ ID NO: 317871 - DNA, 2594 bp, Homo sapiens
cagattttgtgccaatttgaagccacagaaatgatgtggattgttaattgtgttttagaacatccccggacactcagtgtcacagggggaaagaagtgggtaccacattctgtttatatttcacattttaactagatttgagtgtttttagcaagaaatcagtcttaaaatctaatgtctgggatccagaagaaaatgtctttaatctgtgagttattgtcacaatgtcatcttatttaaatgtaccaattagcattttgtaataggcaaatgtcatttagtgcttttcaccaatcccactcacccccggtgctccgccttgcctaagaaaaagaaattaaggagaagtaaactttatttcctaatataatgtcagctgatatttattgagcttttcctctttgcccagagactaggacccaaagaagttaagtaactattcccaggtttatttctctctcatatgatgtcccatgtggatgtttgtggtcagtggacagctttccacctagtctttctgcgacccaggctccttcctcttggggctctgcctttctctcagtccatagagccctctttgttgaaagagcacataggaaaagaaggaaaagtctgtgtggaaaatgtttctgggtcaggcctggaagtggtgcatatctcttccgcccatgttcctttggacagaactccgtcacatggcccacctagagagattttgggaaatgtgtccagctgtgtgcctgggaggaagggggcaccattttcttgagcagctagacagtttgccgtatttgtggtgttctcctcttgttgatgttgaaatggtgaatgagccataaagtatttcaggttatccacacactaatcatctcagtgtctttaattcttaactccaatatgaatgtttaaagcttcctctagattcttattcctatataactaatagagaagaaaggacagcttcctatggggaagacagaggcttcctcatagatgttaggaataatcaaacttgcccctgccctttcacccgtctcaaattctggtcttttaaagcagcgttatgttaagtagtcctaacattgtaatatacagtactgccacattctcctactttctattagaggaagtcagagaatatttatggaagtgaggacccaaattaccttctacagatgacttttatagttacaggacagaaagtgaaaatcaaggttacgttttctacttttgtggtagaaattgagaagtgggtggatatggttcgagaagacctttcagaaacacagagactgagtctttgtcttccatgctgtctctgcagtactgagtgaatttccttatacccttgtatcatgttttcctcccatcttctagaagctggggacagatttggaagagaattacacaagttcagttttttgatacatggattttacagtgcatgcaggttatttatgtagagaggaggtctgggagaaagatggaaactagggagatgactgagaacaaagatatttgggattaacacagatagaagaaaagtttgaaaccatgagattgtcacagcatgaaaaaagatattcaaagacactaaccaacttgaggggtgcagtggtctgaatgtgtcctccaaaattcaaatgtggaaatgtatttgccagtgagatagtatgtagaggtggggccttgaggaagtgattaagtcatgagggctctgggattaatgacttaaaaagaggtgtgaggcagctgttcagcccttctgtctcctgtcccttttttttttttttttttgagatggagtcttgctctgttgccccaggctggagtgcagtggcgtgatcttggttcactgcaagctccacctcccgggttcacgccattctcctgcctcagcctcccgagtagctgggactacaggtgcccgccaccaccacgcccggctaattttttatatttttagtagagatggggtttcaccgtgttagccaggatggtcttgatctcctgacctcatgatctgcctgcctcggcctcccaaagtgctgggattataggtgtgagccaccatgcccagccccttctgtcccttctaacgtgaggacccagcaacaaggtaccatcttgaaagcagcaactggggactcagcagacaccaaaccaactggtgcttaaccgtgacttcccagcctccagagctgtaagaaaataaatttctattatttatagattacccagttgaagatactttgttaaggcagtacaaatggactaagacaagggggaagaaatttgcattcctgatcttcccaacttcttcaaattcacaacacttgaatgacagtcttatttcagcacttactgctatcacctattacttttatgtgtgtcttacctatttgagatgccagattccttggaagtagagaccgtgtctgaatcatcattgtattaaaccgctcatccttaacaaatgcccaagccatggttaaagttcaataaatactttgttgaatttattaataaaatggcagaaatgtcattctcttccatatatgtttaataaatccctgataggtgctaagcactgc

SEQ ID NO: 317872 - DNA, 372 bp, Homo sapiens
agcataaactattacagcataaactattacagcataaactattaccagaataaatttcctctccgtttgcagtcattctccccagccctaggtcaccactgatccaccttctgttactggaaggttagttttcttccctgatttagaatttcatataaattaaatcagatagtatatactcttgtgtttagtttctttagcttaacatgtttagagatatttgctgttgcctgtgtctgtagctttttgttttcattgctgaatagtatttcattgtaatataccacagttggtttatgtatttgctgatgaatatttgtgttatttccagcgtgggattattatgaataaagttgctacaaacatttgtat

SEQ ID NO: 317873 - DNA, 4729 bp, Homo sapiens
cagattttgtgccaatttgaagccacagaaatgatgtggattgttaattgtgttttagaacatccccggacactcagtgtcacagggggaaagaagtgggtaccacattctgtttatatttcacattttaactagatttgagtgtttttagcaagaaatcagtcttaaaatctaatgtctgggatccagaagaaaatgtctttaatctgtgagttattgtcacaatgtcatcttatttaaatgtaccaattagcattttgtaataggcaaatgtcatttagtgcttttcaccaatcccactcacccccggtgctccgccttgcctaagaaaaagaaattaaggagaagtaaactttatttcctaatataatgtcagctgatatttattgagcttttcctctttgcccagagactaggacccaaagaagttaagtaactattcccaggtttatttctctctcatatgatgtcccatgtggatgtttgtggtcagtggacagctttccacctagtctttctgcgacccaggctccttcctcttggggctctgcctttctctcagtccatagagccctctttgttgaaagagcacataggaaaagaaggaaaagtctgtgtggaaaatgtttctgggtcaggcctggaagtggtgcatatctcttccgcccatgttcctttggacagaactccgtcacatggcccacctagagagattttgggaaatgtgtccagctgtgtgcctgggaggaagggggcaccattttcttgagcagctagacagtttgccgtatttgtggtgttctcctcttgttgatgttgaaatggtgaatgagccataaagtatttcaggttatccacacactaatcatctcagtgtctttaattcttaactccaatatgaatgtttaaagcttcctctagattcttattcctatataactaatagagaagaaaggacagcttcctatggggaagacagaggcttcctcatagatgttaggaataatcaaacttgcccctgccctttcacccgtctcaaattctggtcttttaaagcagcgttatgttaagtagtcctaacattgtaatatacagtactgccacattctcctactttctattagaggaagtcagagaatatttatggaagtgaggacccaaattaccttctacagatgacttttatagttacaggacagaaagtgaaaatcaaggttacgttttctacttttgtggtagaaattgagaagtgggtggatatggttcgagaagacctttcagaaacacagagactgagtctttgtcttccatgctgtctctgcagtactgagtgaatttccttatacccttgtatcatgttttcctcccatcttctagaagctggggacagatttggaagagaattacacaagttcagttttttgatacatggattttacagtgcatgcaggttatttatgtagagaggaggtctgggagaaagatggaaactagggagatgactgagaacaaagatatttgggattaacacagatagaagaaaagtttgaaaccatgagattgtcacagcatgaaaaaagatattcaaagacactaaccaacttgaggggtgcagtggtctgaatgtgtcctccaaaattcaaatgtggaaatgtatttgccagtgagatagtatgtagaggtggggccttgaggaagtgattaagtcatgagggctctgggattaatgacttaaaaagaggtgtgaggcagctgttcagcccttctgtctcctgtcccttttttttttttttttttgagatggagtcttgctctgttgccccaggctggagtgcagtggcgtgatcttggttcactgcaagctccacctcccgggttcacgccattctcctgcctcagcctcccgagtagctgggactacaggtgcccgccaccaccacgcccggctaattttttatatttttagtagagatggggtttcaccgtgttagccaggatggtcttgatctcctgacctcatgatctgcctgcctcggcctcccaaagtgctgggattataggtgtgagccaccatgcccagccccttctgtcccttctaacgtgaggacccagcaacaaggtaccatcttgaaagcagcaactggggactcagcagacaccaaaccaactggtgcttaaccgtgacttcccagcctccagagctgtaagaaaataaatttctattatttatagattacccagttgaagatactttgttaaggcagtacaaatggactaagacaagggggaagaaatttgcattcctgatcttcccaacttcttcaaattcacaacacttgaatgacagtcttatttcagcacttactgctatcacctattacttttatgtgtgtcttacctatttgagatgccagattccttggaagtagagaccgtgtctgaatcatcattgtattaaaccgctcatccttaacaaatgcccaagccatggttaaagttcaataaatactttgttgaatttattaataaaatggcagaaatgtcattctcttccatatatgtttaataaatccctgataggtgctaagcactgcactaggtaaaaattctcttctgatgctgtctttttggccaaccatttttttatcatttattcattagctgacatttgctaagtgctttggaggggtcaaaaggggaagtaatgagaaatcaaagatggtccctacatcaaggataaactatctttttttagtcactcaaagtcataaccctttggaaacaaaacccaccagtaccccagattttgaccacagatgaatcagtactacaaggactggttagagggttgaatgaatctgtatactcagcacttaacacagcactctgggtaaaagaaaaaagatcctcaaagatattagttggttacatcaagaaaggacaaacttaggttaatctataacttcatctcagaggaacaggaactttggagataaacagggctctgccacttgcaagttgcaccatccctggtttctccatctgtaaattgattaaaacactgcctatctaataagattaaataagttagaagcattcagttaaatgtcaactgaaactattgttcatgtaaattgtgcttgatgctttttctttctagattcaatgattattgtcattttacctccataggccctcaatagaaatcagttgcagagggcagaagcctagatattttcaccttaaaattggagggtgaaagacattgaggtgaagtagagatagagggtacacagaaaaatcgtataagtaaaactaacatcgttaacattatttactgtaagttatctttgtaagagtggtaaaatacattgtgttgttaaataatttcatttaaaaaatgcatcactttgtgtgtttttatattgctaaaaccataaggccagtctacaaggtttgtagataaaatagaaacataccttccttgaaaagcagaataaattttttaaaggcaggaaggaagtgtttgaaccatgtgtcaacaagctttactgtcaaagcaggcttttggtatgggaagaaaaatacttataaatacttgttttaatatttgctttattaaaatacatttaaaatacagcatttttaaatctctaagctcaacttgaagatataagaacagtaaatttgataaaaatgagaaattacattcccatttctttaacaatttgtaaattccaattatcctgaacatttaataccatttacatattttattaatcacattttcttaaacatttgataagagatttaatattttgatccaactaccaaaaaagcagacttgtgtacttgacagatttttctaaacacttcacaactcacgattcaaacaaagacaaaatagcatatcaaaagttaatcactcagttggaaagcactcataccataggcttttattcatttcttgaataattttgttatatcttcctcttttaggctgcaatgagctataattgcactactgcactccacgctgggtgacagagcaagaccctatctctaaaaataaaaaagtatatatatataaaaatatcttcctctattataatttaactcattaagccatttatttagatgtaaacttgcccccctgacatgtggtatgaaacaaatagaaacctagaaatttagtgcatattcaaatattaagacagacactggtgtggtgacttttgtctgtcgcttcattgggacgttttttctttctgatcaacttaatgaaattataatttactataattaagtgtagccatttttactgtagagttcaatgatctttgatgaacgtgtacacccatgtaaccaccacccccaatcaaagtaaagaacattttcttaccagaataaatttcctctccgtttgcagtcattctccccagccctaggtcaccactgatccaccttctgttactggaaggttagttttcttccctgatttagaatttcatataaattaaatcagatagtatatactcttgtgtttagtttctttagcttaacatgtttagagatatttgctgttgcctgtgtctgtagctttttgttttcattgctgaatagtatttcattgtaatataccacagttggtttatgtatttgctgatgaatatttgtgttatttccagcgtgggattattatgaataaagttgctacaaacatttgtat

SEQ ID NO: 317874 - DNA, 1100 bp, Homo sapiens
  misc_feature (53)..(53): n is a, c, g, or t
ctctctctctctctctctctctctctctctctctctctctctctctctctctntaaatttgataaaaatgagaaattacattcccatttctttaacaatttgtaaattccaattatcctgaacatttaataccatttacatattttattaatcacattttcttaaacatttgataagagatttaatattttgatccaactaccaaaaaagcagacttgtgtacttgacagatttttctaaacacttcacaactcacgattcaaacaaagacaaaatagcatatcaaaagttaatcactcagttggaaagcactcataccataggcttttattcatttcttgaataattttgttatatcttcctcttttaggctgcaatgagctataattgcactactgcactccacgctgggtgacagagcaagaccctatctctaaaaataaaaaagtatatatatataaaaatatcttcctctattataatttaactcattaagccatttatttagatgtaaacttgcccccctgacatgtggtatgaaacaaatagaaacctagaaatttagtgcatattcaaatattaagacagacactggtgtggtgacttttgtctgtcgcttcattgggacgttttttctttctgatcaacttaatgaaattataatttactataattaagtgtagccatttttactgtagagttcaatgatctttgatgaacgtgtacacccatgtaaccaccacccccaatcaaagtaaagaacattttcttaccagaataaatttcctctccgtttgcagtcattctccccagccctaggtcaccactgatccaccttctgttactggaaggttagttttcttccctgatttagaatttcatataaattaaatcagatagtatatactcttgtgtttagtttctttagcttaacatgtttagagatatttgctgttgcctgtgtctgtagctttttgttttcattgctgaatagtatttcattgtaatataccacagttggtttatgtatttgctgatgaatatttgtgttatttccagcgtgggattattatgaataaagttgctacaaacatttgtat

SEQ ID NO: 317875 - DNA, 4514 bp, Homo sapiens
agccgggcggaacgctagcggtgttggcgcggagtggaccccggctgcggcccctggcaatggcgccaccatcggtcccggagtcccagtgatgctctgtgccatagagcccccataacttcactactacgtgatagtaaatccccggcaaaaacccgcagcgccttgcaaccccacgccaccccaagcatcccaggactcttctgaaacagggcagtgacccgggaggaagtcaccaggtgcagaggaccgtgccctgtggggacctgcctgcaggctgctgacagactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317876 - DNA, 4438 bp, Homo sapiens
agccgggcggaacgctagcggtgttggcgcggagtggaccccggctgcggcccctggcaatggcgccaccatcggtcccggagtcccagtgatgctctgtgccatagagcccccataacttcactactacgtgatagtaaatccccggcaaaaacccgcagcgccttgcaaccccacgccaccccaagcatcccaggactcttctgaaacgactccgggctaccagatcggccgtccagctggaatcaaccgatggaggctccgctgcaaactggaatggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317877 - DNA, 2402 bp, Homo sapiens
ctgtcctctccctctccccagagctctaatgggtagcgagcgaggcttgcttccctacacccccattgcaggggagccctagatggggcagtacagccccctttccacccatcttcggctctcctcattccccacccaagcagccccaatcatgcacgcggccccccaggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317878 - DNA, 4324 bp, Homo sapiens
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317879 - DNA, 4376 bp, Homo sapiens
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagtgtgccacacgtggaatatacgcgcggaaatgtgtgtcgacaaagactaccgatcagtcgacatacgatgtgagacagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317880 - DNA, 3139 bp, Homo sapiens
  misc_feature (3123)..(3123): n is a, c, g, or t
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctggtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggacggaggcagaagtcgaagttctccggggcaacagaacgcgtggntctggggccccaaagg

SEQ ID NO: 317881 - DNA, 593 bp, Homo sapiens
attggtaatgtctgtcaagggcaggacaggggatgtgtaggcgagtgtgctatgtgcagctgactctgaaataggtttagtctcaaatgcaactcccccagagaatcaggcttttgaggggccagagaatgggcagacagagtggggacaagcaaagcagggttgcagacatggacccagcccctcatttcccacaggatgtgggctaccagtacgggaaggcggtgtttggaggctggagccgtggcaacgtcattgagaaaatgctcacagaccggcggtctacagaccttaatgagagccgccgtgcagacgtaagcctgtgatgcccccagggccactctgactccactgattacagaacccaagcccccttaaagtctccccgaaacctcagatgaccccacatgtccctgggttttgctgagctctcagacctctgctgacttcagagagttcccaccctaggatctcctctgagcccccaatgcaccactgggccccccaggggccccaagactctgtgggccccccctaagagcctcaccagtgtcaccccacaggtgtgcttgccttcccaagctctggcttca

SEQ ID NO: 317882 - DNA, 4353 bp, Homo sapiens
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317883 - DNA, 4431 bp, Homo sapiens
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggtgggcagccgaggggagctgggcacagggcgcaagggaggcctggctgcgcccatctcaacccccctacctccccaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317884 - DNA, 4242 bp, Homo sapiens
agggaagagtcgcgcccccggggagggagcagcactggcccattctgcagatggggacatcgagtcacgggctggctacgaactcctcgggggcgaaggtggcggagagggatgggttccaggacgtcctggcgcccggggaaggctcggcgggacggatttgcggtgcgcagccagtgccgttcgtccctcaggtgcttggcgtgatgatcggggccggagtggcggtggtggtcacggccgtgctcatcctcctggtggtgcggaggctgcgagtgccaaaaaccccagccccggatggcccccggtatcggttccggaagagggacaaagtgctcttctatggccggaagattatgcggaaggtgtcacaatccacctcctccctcgtggatacctctgtctccgccacctcccggccacgcatgaggaagaaactgaagatgctcaacattgccaagaagatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccgggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgacgggaaggagtgtgtggtgaaggaagtggttcctggggacagcgtcaacagccttctcagcatcctggatgtcatcaccggtcaccagcatccccagcggaccgtgtctgcccgggcggcccgggactccacggtgctgcgcctgccggtggaagcattctccgcggtcttcaccaagtacccggagagcttggtgcgggtcgtgcagatcatcatggtgcggctgcagcgagtcaccttcctggcactgcacaactacctgggtctgaccaatgagctcttcagccacgagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggggaccctgtgaagcccacatccctggaaaccccctcggcccctctgctgagccgctgcgtctccatgccaggggacatctcaggcttgcagggtggcccccgctccgacttcgacatggcctatgagcgtggccggatctccgtgtccctgcaggaagaggcctccggggggtccctggcagcccccgctcggacccccactcaggagcctcgtgagcagccggcaggcgcctgtgaatacagctactgtgaggatgagtcggccactggtggctgccctttcgggccctaccagggccgccagaccagcagcatcttcgaggcagcaaagcaggagctggccaagctgatgcggattgaggacccctccctcctgaacagcagagtcttgctgcaccacgccaaagctggcaccatcattgcccgccagggagaccaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggcagggcgaccgctccgactgcacttacatcgtgctcaatgggcggctgcgtagcgtgatccagcgaggcagtggcaagaaggagctggtgggcgagtacggccgcggcgacctcatcggcgtggtggaggcactgacccggcagccgcgagccacgacggtgcacgcggtgcgcgacacggagctggccaagcttcccgagggcaccttgggtcacatcaaacgccggtacccgcaggtcgtgacccgccttatccacctactgagccagaaaattctagggaatttgcagcagctgcaaggacccttcccagcaggctctgggttgggtgtgcccccacactcggaactcaccaacccagccagcaacctggcaactgtggcaatcctgcctgtgtgtgctgaggtccccatggtggccttcacgctggagctgcagcacgccctgcaggccatcggtccgacgctactccttaacagtgacatcatccgggcacgcctgggggcctccgcactggatagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccagagctggtgctcggggcacctgcacctgcgctgtccgcgccgcctcttttcgcgccgcagccctgccaagctgcatgagctctacgagaaggttttctccaggcgcgcggaccggcacagcgacttctcccgcttggcgagggtgctcacggggaacaccattgcccttgtgctaggcgggggcggggccaggggctgctcgcacatcggagtactaaaggcattagaggaggcgggggtccccgtggacctggtgggcggcacgtccattggctctttcatcggagcgttgtacgcggaggagcgcagcgccagccgcacgaagcagcgggcccgggagtgggccaagagcatgacttcggtgctggaacctgtgttggacctcacgtacccagtcacctccatgttcactgggtctgcctttaaccgcagcatccatcgggtcttccaggataagcagattgaggacctgtggctgccttacttcaacgtgaccacagatatcaccgcctcagccatgcgagtccacaaagatggctccctgtggcggtacgtgcgcgccagcatgacgctgtcgggctacctgcccccgctgtgcgaccccaaggacgggcacctactcatggatggcggctacatcaacaatctgccagcggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317885 - DNA, 1126 bp, Homo sapiens
cagaaaataaaacaaaacctcccaacacctgacccccctcctcaacttcagttgcatcatttgcacgcctgtgcatgacagcatggtgtttgcatgtgtgggtattctctctctcttttttttttgcgtgatcatttgcatgatggcatctgtgggactgggttgaacatctctgccccgggcccccgaaggggagcagcccgctgacccccctggccccacacggacatcgcccgcagcatgggtgccaaaacggtcatcgccattgacgtggggagccaggatgagacggacctcagcacctacggggacagcctgtccggctggtggctgctgtggaagcggctgaatccctgggctgacaaggtaaaggttccagacatggctgaaatccagtcccgcctggcctacgtgtcctgtgtgcggcagctagaggttgtcaagtccagctcctactgcgagtacctgcgcccgcccatcgactgcttcaagaccatggactttgggaagttcgaccagatctatgatgtgggctaccagtacgggaaggcggtgtttggaggctggagccgtggcaacgtcattgagaaaatgctcacagaccggcggtctacagaccttaatgagagccgccgtgcagacgtgcttgccttcccaagctctggcttcactgacttggcagagattgtgtcccggattgagccccccacgagctatgtctctgatggctgtgctgacggagaggagtcagattgtctgacagagtatgaggaggacgccggacccgactgctcgagggatgaaggggggtcccccgagggcgcaagccccagcactgcctccgagatggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaa

SEQ ID NO: 317886 - DNA, 1052 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatct

SEQ ID NO: 317887 - DNA, 593 bp, Homo sapiens
cccacgcgtcgcccacgcgtccggacccacgcgtccgaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatct

SEQ ID NO: 317888 - DNA, 1038 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaatccactggccgtcgcttaccaccgtcgtgactgggcctggcgtaaccaagtaatcgcctggagtaattcccctttcgcagttgggtaataggggccgcgatgccttac

SEQ ID NO: 317889 - DNA, 2806 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacacacacacacacgtgcaaaaaatatgatcaagaatgcaattgggatttgtgagccatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaa

SEQ ID NO: 317890 - DNA, 3516 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacacacacacacacgtgcaaaaaatatgatcaagaatgcaattgggatttgtgagccatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaatgaataaattcccatagcactttattcttcacatggtacataactataggggctatagcttggtaccttgtgaagcaactcttggtgtaacataccttatttctcatactaaaatgcaagaacctttagagcaaggatcttgccattcatctttgtaacctctttactctggagcacttgcatttagcaggcatcataaagttttacgtaccaagaaaatgttgctgttttctgaatactatgcatcaaaaaatgttaccactaatttttaaagctctgctaaggaatattggggcaccctcagatgcaccttttaattgatgtcatattttcctaatccatactttattcatgagaatttgagtcaccccagcattagcttggaatttccttatttcccatttgctttgcaggtgccttggagtcagatctggttttgaatactatcttcctgttatgtgatcttgggcagttacttaattttctagtcaataacccgtatctataaaatagagaaaataattctacacaccggggcctgttgtggggcggggagaggggggagggatcgcatttggagatatactaatgtaaatgacaagttaattggtgcagcacaccaacatggctcatgtctacatatgtaacaaacctgcacgttgtgcacatgtgccctagaacttaaagtataataaaaagaaattttaaaa

SEQ ID NO: 317891 - DNA, 2545 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacacacacacacacgtgcaaaaaatatgatcaagaatgcaattgggatttgtgagccatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtc

SEQ ID NO: 317892 - DNA, 1407 bp, Homo sapiens
cagcataagcgttgtcctgagcgatgggatctgatgccttttgatggtctttgcagtgaatgactccagcttcctttggaagtaaagcagctttgagaagagtttttattaaagaggcattgatgatggaggacccttgcatagtgaggaaacctctttctgcccatataacatcatggtggtacaggatatgtgaagtgggagcaggcatttcaaatggcggaaagcagtacaagagagggagagtgtggtgggaggtgccacatacttttcaatgaccaaatctcatttgtattcagagcgagaactcacttatcaccaagggaatggcccaagccgttcattagggatttgcccccatgatctacgcagctcctgccaagccccacctcattacatttccacatgagatgtgagtgtggacaaatgtttaaactataaggataaaaagcaagatctttaggagataagcatagagatttaggagattagcctacctgtcatgttcaagtttctatgtaggactcatatgatatagacccttgggccaactttaccctgttgcatgccccgtctctcacatgcaatacagtgactggtatgtagtgatgattttatcagtgaggatcctggtagtaataggtggattttttttttcttttctgaagatagtttattgaagggactgttttcagaggtgtgaccatggtttaagataaccaagaaaggatgatgaatcacttagggactagcagcacttggaaactgttattcatccaggtgacagggcaagggtagaaatcatgttccagaactcagtgagagttgtaggcatgaaagaggagccttctcaacaggagctgtggccaaaaaagaaacaaggcaggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatct

SEQ ID NO: 317893 - DNA, 2480 bp, Homo sapiens
tcttggggggtggggggggaaagtccagcagtatgcctctggaatccaaatacttgtctgctacaccgtatataccgccttccccccaaataacttagaagcataagttttcaaacttacagtattgtctgcagaagctgactcccctaacctatatgttgttttgttttttaaattgattgagaataaggattggcattacaaaggactgaagaaaaacacatgtaacattgaatcaatgatttattttgatggttagtggaattaagtggaaagctgtagtttcatatttgtccacaagatggtgaaattctcattaggtataattttttgaaacccatataaacccttaatttataatctgcatttgatgctatttattataagcactgtaatttctttttacagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacacacacacacacgtgcaaaaaatatgatcaagaatgcaattgggatttgtgagccatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaa

SEQ ID NO: 317894 - DNA, 925 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaaggtaggtgtgcagcataagtattgttttgttgtgtggccaagcttgtctttaaaaaagagaaaacgttacaataaggttatacttagacttaaaattatgagtaggtggcagaggagaaaatatcaaatttttatattttaaagcctcaaatctaaaagtatcccactcccctaaaaaaacaaaacaaaaca

SEQ ID NO: 317895 - DNA, 196 bp, Homo sapiens
tgatgtgccagggggatgtgggtggggtggccagagccaagagcagagtgtgaataggagcgtggttggggccctgggcaaagtgtggggcagcacatgaaagggctgtgggtggcctacggtgggttgtgggtgaggcatgggtgaggccttgggtagagtgcggtcaggctgtggtcaggcagtggttgggcag

SEQ ID NO: 317896 - DNA, 5883 bp, Homo sapiens
gtgaggagggccggcggcggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 317897 - DNA, 937 bp, Homo sapiens
aagggtctgcttgttcttgtagcttttctgttttttaacctttgttccgccatttaaaaaaacaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 317898 - DNA, 960 bp, Homo sapiens
gggatggagcctggggtccgaggcctcccagcccaggtttctacctaacaattccgacatggttcacattcatcaagactaaagccatccctcgggagagaccctggctaccgaccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 317899 - DNA, 620 bp, Homo sapiens
tagctaaagcgtgttgtcttctcccgagggtgtgcacaggttcatgtatcagctgaataaggccctgttccaaaaactgatatttcaagggaaccttaatttatctttaaatttaatgctggtccctgcagacggcttcccatttttatgaccggatgctgggaagcctgctggtccacaggtccatacatgaagtcaccataagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgc

SEQ ID NO: 317900 - DNA, 5424 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 317901 - DNA, 5146 bp, Homo sapiens
tgcattcaaatataaacagactgctttaaggaatcaaagttgacttacagagccaacaaaagcccctcaggaaaacgcctcataccttgtgcggtttctgtacagggttcctgacttgtggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 317902 - DNA, 4759 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgcacaaaacaatttttctttttttttgggggggtgggacaacccccggccaaccaggggg

SEQ ID NO: 317903 - DNA, 4344 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 317904 - DNA, 2091 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacacaaagacaacaggaaattctgctaaagcgcgtccatgcacgtgtgttgaagcccttcagaggaagcaaagcggtagctcactttgaaggggccaggatagaattaccgagtaacacctgcctttgaggtaaggatggttttgagtcaggcacagtggcttacgcctataatctcagcaccctgggaggccaaggcaggacgatggcttgagcccaagagttcaacatcagcctgggcaacatggtgaaaccccatctctacaaaaacttagccaggcgtggtgacgtgtgcctgtagtcccagctactcaggaggctgaggcaggaggatggcttgagcccaggagattgaggctgcagtgcgcggtgatcacaccactgcactccagcctgggtgacagagcaagaccatgtctcaaaaaaaaa

SEQ ID NO: 317905 - DNA, 1067 bp, Homo sapiens
gtgaggagggccggcggcggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctg

SEQ ID NO: 317906 - DNA, 199 bp, Homo sapiens
tttgctcggtccgatgtccagatgccagtctgttatgagagcttctctgacccttcatgacgatgttccaataaactttactgacaaacatcggtggagggctagattgggcgtgggggccgtagcttgccgacttctcactctaaaggcatctttgtattgtctctcaagatgacaggtgctttatctttccttccag

SEQ ID NO: 317907 - DNA, 5318 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaatcaccttgtgtgttgtagctcatttgtttcaagagagaatcaacagatcatattcagtgtcttgaataaattgctctattttgatattaaaaaaaaaaaa

SEQ ID NO: 317908 - DNA, 4300 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggatttttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctcttctccctccccttcttgttctgtcggctttgtgagcaaccttaccatcgaacg

SEQ ID NO: 317909 - DNA, 565 bp, Homo sapiens
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccgg

SEQ ID NO: 317910 - DNA, 1588 bp, Homo sapiens
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatctatatctgtgactgactttaaaaaggtatttgacacttgaaatttttttcaaatatgtaatctcatcaccatgtcttatataagataatttactcctgtttcttactgcttctcactgtttcctgtagtgaagttctctaaacttgttaagttatacctggtgttgggattagaagtccttacataagaattgactcttaatctctgagtgactataactccctgatttctttgctatatatgacaaaatatttgataaatagcagcaacctgaacctgtcaaactagtgaatgcagcccagttcatattagaagagcaagagactggacatgcttcagtatttgcttttcttttggtagccagaatgttacctgaaagctagcaaa

SEQ ID NO: 317911 - DNA, 1035 bp, Homo sapiens
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaatgacaagggggaaagggaagaggtgacaagaatcacaagtgtgaaaagttgtagttacagggacagctctagagttgatcattgagatccagtcccgtgtttgccgacctggtattattgttatgagttggagactttagtaaaggaggctggtcgttacagcaagagggggaacgtagtgggcggcaaaggttgtttta

SEQ ID NO: 317912 - DNA, 1476 bp, Homo sapiens
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatctatatctgtgactgactttaaaaaggtatttgacacttgaaatttttttcaaatatgtaatctcatcaccatgtcttatataagataatttactcctgtttcttactgcttctcactgtttcctgtagtgaagttctctaaacttgttaagttatacctggtgttgggattagaagtccttacataagaattgactcttaatctctgagtgactataactccctgatttctttgctatatatgacaaaatatttgataaatagcagcaacctgaacctgtcaaactagtgaatgcagcccagttcatattagaagagcaagagactggacatgcttcagtatttgcttttcttttggtagccagaatgttacctgaaagctagcaaa

SEQ ID NO: 317913 - DNA, 1547 bp, Homo sapiens
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatctatatctgtgactgactttaaaaaggtatttgacacttgaaatttttttcaaatatgtaatctcatcaccatgtcttatataagataatttactcctgtttcttactgcttctcactgtttcctgtagtgaagttctctaaacttgttaagttatacctggtgttgggattagaagtccttacataagaattgactcttaatctctgagtgactataactccctgatttctttgctatatatgacaaaatatttgataaatagcagcaacctgaacctgtcaaactagtgaatgcagcccagttcatattagaagagcaagagactggacatgcttcagtatttgcttttcttttggtagccagaatgttacctgaaagctagcaaa

SEQ ID NO: 317914 - DNA, 773 bp, Homo sapiens
  misc_feature (730)..(730): n is a, c, g, or t
  misc_feature (744)..(745): n is a, c, g, or t
  misc_feature (752)..(752): n is a, c, g, or t
  misc_feature (754)..(754): n is a, c, g, or t
  misc_feature (759)..(759): n is a, c, g, or t
  misc_feature (761)..(761): n is a, c, g, or t
  misc_feature (765)..(765): n is a, c, g, or t
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaacagagcnagactccatctcannaaaaaanangaagnanaagnaaaaaaaa

SEQ ID NO: 317915 - DNA, 607 bp, Homo sapiens
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgaaagtcagccctcgacacaagggtttgt

SEQ ID NO: 317916 - DNA, 1195 bp, Homo sapiens
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttctt

SEQ ID NO: 317917 - DNA, 1339 bp, Homo sapiens
  misc_feature (1197)..(1198): n is a, c, g, or t
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagaagtggaggccattctgcttgaagtttaatgggattgttgaagacttcaactatggtactttgctgcgactagattgttctcagggctacactgaggaaaacaccatctttgcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttctttnntaaaaagttattctgttgttgtaaatgttataaaactctgggggggggcccggtaccccaattaccctttagtgaggttgttttccaattaattggcggtggtttacaaaacgtgtggaatggtaaaaccctgcgttaccc

SEQ ID NO: 317918 - DNA, 1235 bp, Homo sapiens
atttgggaagttctctgttattatccctttgaataaactttctactctgatctctctctctacctcctctttaaggccagtcattcttagatttgcccttctgaggctattttctacatcttgtaggcatgcttcattctttttccttttgtcacctctcattgtgcattttcaaatagcttgtcttcaggctcactaattcttctgcttaagtctgctgttaagagactctgatgataatcaattctgttcacttttcagcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttcttattatctatatctgtgactgactttaaaaaggtatttgacacttgaaatttttttcaaatatgtaatctcatcaccatgtcttatataagataatttactcctgtttcttactgcttctcactgtttcctgtagtgaagttctctaaacttgttaagttatacctggtgttgggattagaagtccttacataagaattgactcttaatctctgagtgactataactccctgatttctttgctatatatgacaaaatatttgataaatagcagcaacctgaacctgtcaaactagtgaatgcagcccagttcatattagaagagcaagagactggacatgcttcagtatttgcttttcttttggtagccagaatgttacctgaaagctagcaaa

SEQ ID NO: 317919 - DNA, 1083 bp, Homo sapiens
gagtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctgtggcacatgcgctttctctcccagcagagtcgtatggcaacgatcctgacattgagatggcttgggccatgagagcaatgcagcatgctgaagtctattacaagctgatttcatcagttgacccacagttcctgaaactcaccaaagtagatgaccaaatttactctgagttccggaaaaattttgagacccttaggatagatgtgttggacccagaagaactcaagtcagaatcagccaaagagcccccaggatacaattctttgccattgaaattgctcggaaccgggaaggctataacaaagctgtttatatcagtgttcaggacaaagaaggagagaaaggagtcaacaatggaggagaaaaaagagctgacagtggagaagaagagaacaccaagaatggaggagagaaaggagctgatagtggagaagaaaaagaggaaggaatcaacagagaagacaaaactgacaaaggaggagaaaaagggaaagaagctgacaaagaaatcaacaaaagtggtgaaaaagctatgtaaggtatacagggaacagcactctagaagctatgactcaattgagactacaagtaccacggtgctacttgcacagacccctttggttaaatgtaaattcttgtacaattgaaggatacgcagaaggacatctttctagtctaacagtcaggagctgctctggtcattcccttgtatgaactggtctaaagactgttagtggggtgttagttgatttttcctggtatactgtttcttggctgacactactggtcaagtaagaaatttgtaaataaatttcttttggttctt

SEQ ID NO: 317920 - DNA, 478 bp, Homo sapiens
gacatgtggggtgaggactagatatgctgtccagctagggtagagggccagtgtatgtaatggcacagagttgtaaaattgcatggaaggaaggtacatgagcacataggttgtcagtatgactagagtcaagatgggtagagaatctataggaaaggaagttggagagaaagccagggtctctagacaatggatgatttcgtatcatgggaaagactggtttttatctcgtagatggaagagagccactgaaccacagtcagggaaataatataattgtgttttccatttggaatcactttggtagatagaaccattattatctttgttacgatattcccttttgtcattctcatgaaaggctttatcccaacctatgtatttgataaggcatggtgggggaggcaaacagttaaatgcattaacttttctggattgttcggtggtggaaaattcattgtagtcactgtaggtggcc

SEQ ID NO: 317921 - DNA, 280 bp, Homo sapiens
aaatggctccctcactatggacttagccactttgagggctgaacagtagctcatccactctctggttttcctttggaattcagtaatgaactcattaaatcaccaacttgttgtgacaggaagtcattcagatgctgatgctattgccatggaaaccatccctctgcgaggagctctgtctgtctttgtcgaggagcactccagctccataattactgtcacccccaaataacacagagccatcacgactgtgagcaagtccagaagcaggggcacacag

SEQ ID NO: 317922 - DNA, 482 bp, Homo sapiens
tggattggcgaccacggccgtcgcggacgcgtgggctcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317923 - DNA, 3073 bp, Homo sapiens
atctccaacaagacagaattactcataattggtttttaagacacattagggaagctgcaatcctgtgttcatgcgattgatccccggaaagatgtcagctcctcagattgtgtttcttcagcaagttggttacttagaccttttacatgggtgggagtttaaggcttggcaccccatctcaactaggcttactcttcaccttccaggtgtgactctatctctcagaaaatttcttcattttctttctgcataatgtgtgatctgccgcagtatgttgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317924 - DNA, 2666 bp, Homo sapiens
  misc_feature (11)..(11): n is a, c, g, or t
tagaggatccnccgacccgaagacccagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317925 - DNA, 1980 bp, Homo sapiens
tgctagtacgaggctgggtgttaatcggccgaggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317926 - DNA, 3381 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtgaaaaaaacaacacaaggcaaacaccacacaagccacaaccacaaaaggggggcgcacaaaaaaatacc

SEQ ID NO: 317927 - DNA, 1286 bp, Homo sapiens
ggaaacggctttaacgagatggcgttcttgctagcgtcgactcgaatgagacaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317928 - DNA, 1090 bp, Homo sapiens
tcgctacccatacactggaagtcggacctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317929 - DNA, 3161 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccatgccttgtccagcactgttctgtcagtctcccccaggggtggggggtatggggaccattcattccctggcattaatcccttagagggaataataaagctttttatttctctgtg

SEQ ID NO: 317930 - DNA, 3501 bp, Homo sapiens
  misc_feature (3284)..(3284): n is a, c, g, or t
  misc_feature (3437)..(3437): n is a, c, g, or t
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtgaaaaaaaaaaaaaaaaaactcgagaagtttcatagcaaatgtttaaaaaatagagattttgcagatgcatgttctgtattgtgaaaacaaatggtaaaattctttgaacaatgagaggaaaaaatctcctttacatggaggcactttgaattcatnccatcttctaagagaaagaggtgagattttctgcacaaacagagtaccatctgtggaaaagacaacattctgatttagaagaaagggctgaggaaattacacaaaagtgtatcgacacagaaagcttgaatactaatctaaatatgcatcatncacacggcatgaaaaaataaggtcagcttattctctttttttttgcatatttctaaaattaaag

SEQ ID NO: 317931 - DNA, 2402 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgtgcgtcccccagagagcccctcccccagggcagcacacccagttcccttcctcctcggcctcttcactcctcaaaattggggatcccctgctccccacttctgaggttcatcctttgagcattcttacttctcactgcccaaccctgactacagctcagacttccagggctctggggacctgaaggggacagtcaggggctatgacatgcccccctctctcttaggaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcaggtgacccgtagcctcgtcccacaccggtcctttgcctgga

SEQ ID NO: 317932 - DNA, 957 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggcttacatcctcattactattttttaaccaaatcaacaacaacctatttagctgttccccaaccttttcctccgaccccctaacaacccccctcctaatactaactacctcagctccttcacccagctaggttcacgctcggtt

SEQ ID NO: 317933 - DNA, 3117 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccaattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317934 - DNA, 3313 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317935 - DNA, 3539 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgtgcgtcccccagagagcccctcccccagggcagcacacccagttcccttcctcctcggcctcttcactcctcaaaattggggatcccctgctccccacttctgaggttcatcctttgagcattcttacttctcactgcccaaccctgactacagctcagacttccagggctctggggacctgaaggggacagtcaggggctatgacatgcccccctctctcttaggaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317936 - DNA, 3259 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcactgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317937 - DNA, 3686 bp, Homo sapiens
  misc_feature (3469)..(3469): n is a, c, g, or t
  misc_feature (3622)..(3622): n is a, c, g, or t
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtgaaaaaaaaaaaaaaaaaactcgagaagtttcatagcaaatgtttaaaaaatagagattttgcagatgcatgttctgtattgtgaaaacaaatggtaaaattctttgaacaatgagaggaaaaaatctcctttacatggaggcactttgaattcatnccatcttctaagagaaagaggtgagattttctgcacaaacagagtaccatctgtggaaaagacaacattctgatttagaagaaagggctgaggaaattacacaaaagtgtatcgacacagaaagcttgaatactaatctaaatatgcatcatncacacggcatgaaaaaataaggtcagcttattctctttttttttgcatatttctaaaattaaag

SEQ ID NO: 317938 - DNA, 3128 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317939 - DNA, 3229 bp, Homo sapiens
agcgctggttgcccatgcggccctagggctgggagcgcggcgccgctctccgctgcgggggaggccatggcggaaccttcccaggccccgaccccggccccggctgcgcagccccggccccttcagtccccagcccctgccccaactccgactcctgcacccagcccggcttcagccccgattccgactcccaccccggcaccagcccctgccccagctgcagccccagccggcagcacagggactggggggcccggggtaggaagtgggggggccgggagcgggggggatccggctcgacctggcctgagccagcagcagcgcgccagtcagaggaaggcgcaagtccgggggctgccgcgcgccaagaagcttgagaagctaggggtcttctcggcttgcaaggccaatgaaacctgtaagtgtaatggctggaaaaaccccaagccccccactgcaccccgcatggatctgcagcagccagctgccaacctgagtgagctgtgccgcagttgtgagcaccccttggctgaccacgtatcccacttggagaatgtgtcagaggatgagataaaccgactgctggggatggtggtggatgtggagaatctcttcatgtctgttcacaaggaagaggacacagacaccaagcaggtctatttctacctcttcaagctactgcggaaatgcatcctgcagatgacccggcctgtggtggaggggtccctgggcagccctccatttgagaaacctaatattgagcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccagatggctctgttactgccacgtgccccagagctgtgatagcctcccccgctacgaaaccactcatgtctttgggcgaagccttctccggtccattttcaccgttacccgccggcagctgctggaaaagttccgagtggagaaggacaaattggtgcccgagaagaggaccctcatcctcactcacttccccacccaagtaaggctccttctggcctaccaggatttggccccaagttcacatcctccctgttgtccccttttttccaggaaggcttcctggattggtccctcctctccctccatgggccttttgggatctgggcgtctacctggcagacttgcccatggcccagaagcaacttgctagtactagtctggggatggcagattcctgtccatgctggaggaggagatctatggggcaaactctccaatctgggagtcaggcttcaccatgccaccctcagaggggacacagctggttccccggccagcttcagtcagtgcagcggttgttcccagcacccccatcttcagccccagcatgggtgggggcagcaacagctccctgagtctggattctgcaggggccgagcctatgccaggcgagaagaggacgctcccagagaacctgaccctggaggatgccaagcggctccgtgtgatgggtgacatccccatggagctggtcaatgaggtcatgctgaccatcactgaccctgctgccatgctggggcctgagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgaagcacaagactctggccttgatcaaggatgggcgggtcatcggtggcatctgcttccgcatgtttcccacccagggcttcacggagattgtcttctgtgctgtcacctcgaatgagcaggtcaagggttatgggacccacctgatgaaccacctgaaggagtatcacatcaagcacaacattctctacttcctcacctacgccgacgagtacgccatcggctacttcaaaaagcagggtttctccaaggacatcaaggtgcccaagagccgctacctgggctacatcaaggactacgagggagcgacgctgatggagtgtgagctgaatccccgcatcccctacacggagctgtcccacatcatcaagaagcagaaagagatcatcaagaagctgattgagcgcaaacaggcccagatccgcaaggtctacccggggctcagctgcttcaaggagggcgtgaggcagatccctgtggagagcgttcctggcattcgagagacaggctggaagccattggggaaggagaaggggaaggagctgaaggaccccgaccagctctacacaaccctcaaaaacctgctggcccaaatcaagtctcaccccagtgcctggcccttcatggagcctgtgaagaagtcggaggcccctgactactacgaggtcatccgcttccccattgacctgaagaccatgactgagcggctgcgaagccgctactacgtgacccggaagctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317940 - DNA, 927 bp, Homo sapiens
aacccgggacctccttggtcagcccagggctgcagtgtaattaaattattacagctccctacagcctcgacatccctggggtcaagggatcctcctgccgcagcctcccaatattattggggctacaggcatgtatcaccacacctagcctggtggtgctactgtatattcatgtagtcttagataccgctgatgcttctgaatgttttcgcaggatgcaaagggggtcccgggttaacccgtgaccgctctttgtggccgacctgcagcgggtcatcgccaactgtcgcgagtacaaccccccggacagcgagtactgccgctgtgccagcgccctggagaagttcttctacttcaagctcaaggagggaggcctcattgacaagtaggcccatctttgggccgcagccctgacctggaatgtctccacctcggattctgatctgatccttagggggtgccctggccccacggacccgactcagcttgagacactccagccaagggtcctccggacccgatcctgcagctctttctggaccttcaggcacccccaagcgtgcagctctgtcccagccttcactgtgtgtgagaggtctcctgggttggggcccagcccctctagagtagctggtggccagggatgaaccttgcccagccgtggtggcccccaggcctggtccccaagagctttggaggcttggattcctgggcctggcccaggtggctgtttccctgaggaccagaactgctcattttagcttgagtgatggcttcaggggttggaagttcagcccaaactgaagggggccatgccttgtccagcactgttctgtcagtctcccccaggggtggggggtatggggaccattcattccctggcattaatcccttagagggaataataaagctttttatttctctgtg

SEQ ID NO: 317941 - DNA, 419 bp, Homo sapiens
ggggcagagcttttctatagagagcacccgagagagagaggagaaggagaaccttgtccctggccagggagcatcttcctttgtctaagaaggccctgcgggctgctcacacctcattcctggttttatcccccacccaccccttctcagggtgtgctgaactttgtgcagtacaagtttagtcacctggctccccgggagcggcagacgatgttcgagctctcaaagatgttcttgctctgccttaactactggaagcttgagacacctgcccagtttcggcagaggtctcaggctgaggacgtggctacctacaaggtcaattacaccaggtaggcccagccaggggcagcttcgggggaggcttgcaggcccagcctgggttcagtggtttccgccctcacctgtctccccctcga

SEQ ID NO: 317942 - DNA, 742 bp, Homo sapiens
actctatctccagagcgggagccagacgccgacccaagcggaagtgacgttaggtgtccgccggaggtgtcgttggtgtgttgcgcgactggccttgagggagagctggggcctgctcccggagagatacggctatgtcgatcgaaatcgaatcttcggagtgagtcctgcggtggggatgttcgcgccttgccgggggcctggaggttaagggtgtggggcggagggtactcgggagaaggcatccgagaggccagggagtggagggccatttccttgcccccaaagaagcatcttggatctcgctacctcggaggtgggcccacaggaaagtagcagctctcagacgtgaagcccaaaacctcgagggaggtggcacgggtggggaaaacacaccttgcagacctaagttctgtccttggccgactgctggcgcgctgtgattgaccaaattaaggatccactctggactccagtctaattatctgcgcaaggggataggtctctttaagccttgcttctctccctgtccagcttatgcaatgtgattcgttgtctctgcttatacggcccctttgcttttctctgcctagcgtttatcactcagtattgtcactgtttgataacctcaccccaaactagcctttgtcggtgcctaggagctccttttccttgtggtctcagtgtctagcataccttagaggaagagttaattgcttttggaatgaatgaacaactagct

SEQ ID NO: 317943 - DNA, 7216 bp, Homo sapiens
  misc_feature (4498)..(4498): n is a, c, g, or t
  misc_feature (5055)..(5055): n is a, c, g, or t
  misc_feature (5061)..(5061): n is a, c, g, or t
  misc_feature (5075)..(5075): n is a, c, g, or t
  misc_feature (5093)..(5093): n is a, c, g, or t
  misc_feature (5103)..(5103): n is a, c, g, or t
  misc_feature (5985)..(5985): n is a, c, g, or t
  misc_feature (6255)..(6255): n is a, c, g, or t
actctatctccagagcgggagccagacgccgacccaagcggaagtgacgttaggtgtccgccggaggtgtcgttggtgtgttgcgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaataattttgtgaaaattcatgtttaagtagcaactaccctttctttttttatatatttttaaggtattagtttatcttcttctaactggtgcagtcacttaatgttttcattaatcttcgacctggagagtgaaatactgatatttctagaaaaaaattctactcctctgattatttgaaatgctgaggaaaatgtccctcccatagtaaaacttgtaaataaggaactatatcatattcagtagctgtgttctgttccatctttttttttttttttgagatggagttttgcttgttgcccaggctggagtgcagcggcacgatcttggttcactgcaacctccgcctcccaggttcaagcgattctcttgcctcagcctcccgagtagctggggactacaggtgtgcgacaccatgcctggctaatttttttgtatttttagtagagatggggtttcaccatgttggccaggctggtctcaaactcctgacctcaaaggatccacccgccttggcctcccaaagtgctgggatcacaggcgtgagccaccatgcccggcccatctttttttttttttttttttttaaagatgttaataaactttatacctttctggagactttgttctaaaatgtacataaatgctcatctagttaacatatttacttagaatgtgggaggaggagtcacattattatccctgaatctcaagtacagcagaagtgaattcctgggatagtaggatagactaacatgtaaaaaggccaggtgatgcataggttctcatttcactgccctcagccttcctctccttctgagctgtgccttctcacatgttcagtcaactccagggaatattgtctccatcttctggatagaactagttgcaggatccgttacaagaattcagagttttggcatctcccctttgtatgttgtaggagaaggtttggcattgaaaatgtgctgttgttccaaagaaaaattagcaaaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaatttattttatttttctgagatggagtcttgctctgttgcccaggctggagtgcagtggtgccatctcagctaactgcaacttccacttcccaggttcaagcgattctcctgccttagcctcccaagtagctgggactacaggcgcatgccagcatgcctggctaatttttgtatttttagtagagcgggggttttgccatgttggccaggctggtcttgaactcctgacctcaggtgatccgcctgccctggcctcccaaagtgctgggattacaggcatgagccactgcgcccagccttgtaatttacctttgatggtgacctgaaatgcagtatgatcctatatgtggcacgtagtaatgttcagtgtttgctgaattaattctgggcagcactaagaaatccctctttcccagtcatattctataacacatttcccatttgccacaaaacctgcagctttttggtccaggtaatgacatttgctgccattttgatgatttaaaaatggtcgtgggagttgaacatagtcatgaattcaggattcctgagcatgtagacagtcatcccagtggaaagacacgttcacttaagagaagtttaagttagaggaaacagtttatgctaaaaaaatttttagaaaagtccttgagaatttttgatttagtcttgacctcatgaagctggtagttatgatgtgcatagtttgtatcaccgtttatgaagatggagaatctagtcagcacgtgttggtttattctaggaatttttagggaacacttctgttgctggcaccaggtgatgaatatggttaaaaaaagactcgtttctgcctaaacatagggaagaagagcaaattaaaaggagtaattaaaactgataaaagctcaagttacctttgtgatgatgaggcgggcagttaacgcgaaagggttgggaaaggcttcctggagggactagggggcggtctaagcacagggaacctaaccggggactccagtgtggcacagcggcaaggtatgtgctgggcaaaatgataggtgtcttgggagaccaggcaaagagagctggattaggagccgttaagtatatatttttcttctttttaaataaaataatgcactgggtgaacatgtaaacgctaagttgaaaatctgcctttcccaggtaacccttgttaatctttctacaacttcatttcgtacaaacctgaaaaacacactgattttgtctttaaatgggcacacgctgcttacactcctcggcgcctagcctttctgaagccccacgcggccgtccctccagcattgaaggctggggcagcccagctcccctccagcgcccttacagccagaccgcggcggggtcgggccgcgcacgcgcagggcgnacggccggatctggggcgccgctgctccgggtggtcggaggtaggagtcccatcttgggtccagggccggtagagccccttaccgggggtagggagactgcgcacccgctagagccaactgtcagggcctgcagacgtcgggtgacgtcactgttacaaaattggcggtcacatcgtcttaagggccggtggcagcggctgcgcgaacgggagttggctgccgggaatcagtgctcacttccttctgaattgggcgtgtgcagtcggttcctagggaagtgctctgctgcagccaccagatttaacggatgctgctctctagcacttaacatagaagctaaactacctggcgttaaaattaattccatgagcataaggacatttgtcctatcccctattctgctgttgaattaatgactggaaaacattgcgcggaggtatttgggagtagtatggctttttttttttttttttttttaacagcaaatggtataaatctcaggtacaattcagtatcttcttcaccagttgttttttttcagcatgtattattactnccactnacggcctctgttgngcccttccttgctatgtnagcagccatntttaattctcagaacaatgtaatgagggtgcgcaaatgcacatgaagaaacaggtttccagacgtgaggcacctaactcagtccaacttgcacgaagctcgcattgaaaaccagatgtgactccgaagctaggttttttttctctcttgcctcactctcaatattgctgtcagttcctcctcaatctttaggtttgggcagggacaaagaatacatggattgttcctccacatgctgcaaacacattcacctaagcagagcacaggtagtgagatgagtagagagaactgaattagaggattctggatgtcagtctttgctgtcacttcttttggcttgtgctagaacagtggttcttacaagtgtcacgtgatagacacattctaaggtcctatcccagacctacagaatcagaaattggtggtggggcccagcaagcgtgctcaaatttgagagcaggtagactacagggtagtttccgcatatacaaaaggtgttttaattcttgctgtcagtctcagaagtttcatgctgagataaccaaatttaaatgataaaggtgcaagactgactcttaaaatcacattttttcaaattgccatagcttgctagtgttctcattcactgtgcttttacagcttcattttccactattttaagagaagaaattgctatgaagtgtatgtccaagtgaggaagttccctggtctgaggttgtttaaaacttacaataggccgggcacggtggctcaagcctgtaatcccagcactttgggaggccgaggtgggtggatcacgaggtcaggagttcaagaccaccctggccaacatggtgacaccctgtctctactaaggatacaaaattagccgggcatggtggcncacgcctgtagtcccagctacctaggaggctgaggcaggagaatagctggaacccgggaggcagaggttgcagtgagctgagactgtgccactgcactccagcctgggtgacagagcaagacttggtctcaaaaacaaaaaacaaaaaaaccaaacttggaatagcaagggctgcccattatttaaccttccacggcaattttaacagtggtattctgttccaagtggttaatattaaatccatgtgtcagtgttggtggctttcaaccntggctgcgcataatcattttgatgcttaggctacacccagccgagttatacagaatccctggagggtgggacctgatgagtgttttaatgtttcccgggtaattccaatggtagccaaggttaagaaccagtaccgtacgtacaaaaaagttgagaagctaatttcacgtacagaaaatttgccactgttccaagagcactctcaagcgacataattggcctctactcctattccctacaagtatgaatgggcaggagaagcatcacagagaaagcagagttagtgctggaacttgtatttttgtggatgatgaccttggttaatgttttttcataggctctgtttcataggctttgttttttcataggctctccctcattgcattgttctgagaattgaatgtggctgcttgcatggtaatgaggggttcaacggaggctgttggtggtagtgataatacaagctgaaaaactacacagacaaacctatcagtttctgcctcttcaggatataactattaggttggtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaagtattcctttta

SEQ ID NO: 317944 - DNA, 7035 bp, Homo sapiens
  misc_feature (18)..(18): n is a, c, g, or t
  misc_feature (4317)..(4317): n is a, c, g, or t
  misc_feature (4874)..(4874): n is a, c, g, or t
  misc_feature (4880)..(4880): n is a, c, g, or t
  misc_feature (4894)..(4894): n is a, c, g, or t
  misc_feature (4912)..(4912): n is a, c, g, or t
  misc_feature (4922)..(4922): n is a, c, g, or t
  misc_feature (5804)..(5804): n is a, c, g, or t
  misc_feature (6074)..(6074): n is a, c, g, or t
ggtgattagaggatcccntatgtctcgatcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaataattttgtgaaaattcatgtttaagtagcaactaccctttctttttttatatatttttaaggtattagtttatcttcttctaactggtgcagtcacttaatgttttcattaatcttcgacctggagagtgaaatactgatatttctagaaaaaaattctactcctctgattatttgaaatgctgaggaaaatgtccctcccatagtaaaacttgtaaataaggaactatatcatattcagtagctgtgttctgttccatctttttttttttttttgagatggagttttgcttgttgcccaggctggagtgcagcggcacgatcttggttcactgcaacctccgcctcccaggttcaagcgattctcttgcctcagcctcccgagtagctggggactacaggtgtgcgacaccatgcctggctaatttttttgtatttttagtagagatggggtttcaccatgttggccaggctggtctcaaactcctgacctcaaaggatccacccgccttggcctcccaaagtgctgggatcacaggcgtgagccaccatgcccggcccatctttttttttttttttttttttaaagatgttaataaactttatacctttctggagactttgttctaaaatgtacataaatgctcatctagttaacatatttacttagaatgtgggaggaggagtcacattattatccctgaatctcaagtacagcagaagtgaattcctgggatagtaggatagactaacatgtaaaaaggccaggtgatgcataggttctcatttcactgccctcagccttcctctccttctgagctgtgccttctcacatgttcagtcaactccagggaatattgtctccatcttctggatagaactagttgcaggatccgttacaagaattcagagttttggcatctcccctttgtatgttgtaggagaaggtttggcattgaaaatgtgctgttgttccaaagaaaaattagcaaaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaatttattttatttttctgagatggagtcttgctctgttgcccaggctggagtgcagtggtgccatctcagctaactgcaacttccacttcccaggttcaagcgattctcctgccttagcctcccaagtagctgggactacaggcgcatgccagcatgcctggctaatttttgtatttttagtagagcgggggttttgccatgttggccaggctggtcttgaactcctgacctcaggtgatccgcctgccctggcctcccaaagtgctgggattacaggcatgagccactgcgcccagccttgtaatttacctttgatggtgacctgaaatgcagtatgatcctatatgtggcacgtagtaatgttcagtgtttgctgaattaattctgggcagcactaagaaatccctctttcccagtcatattctataacacatttcccatttgccacaaaacctgcagctttttggtccaggtaatgacatttgctgccattttgatgatttaaaaatggtcgtgggagttgaacatagtcatgaattcaggattcctgagcatgtagacagtcatcccagtggaaagacacgttcacttaagagaagtttaagttagaggaaacagtttatgctaaaaaaatttttagaaaagtccttgagaatttttgatttagtcttgacctcatgaagctggtagttatgatgtgcatagtttgtatcaccgtttatgaagatggagaatctagtcagcacgtgttggtttattctaggaatttttagggaacacttctgttgctggcaccaggtgatgaatatggttaaaaaaagactcgtttctgcctaaacatagggaagaagagcaaattaaaaggagtaattaaaactgataaaagctcaagttacctttgtgatgatgaggcgggcagttaacgcgaaagggttgggaaaggcttcctggagggactagggggcggtctaagcacagggaacctaaccggggactccagtgtggcacagcggcaaggtatgtgctgggcaaaatgataggtgtcttgggagaccaggcaaagagagctggattaggagccgttaagtatatatttttcttctttttaaataaaataatgcactgggtgaacatgtaaacgctaagttgaaaatctgcctttcccaggtaacccttgttaatctttctacaacttcatttcgtacaaacctgaaaaacacactgattttgtctttaaatgggcacacgctgcttacactcctcggcgcctagcctttctgaagccccacgcggccgtccctccagcattgaaggctggggcagcccagctcccctccagcgcccttacagccagaccgcggcggggtcgggccgcgcacgcgcagggcgnacggccggatctggggcgccgctgctccgggtggtcggaggtaggagtcccatcttgggtccagggccggtagagccccttaccgggggtagggagactgcgcacccgctagagccaactgtcagggcctgcagacgtcgggtgacgtcactgttacaaaattggcggtcacatcgtcttaagggccggtggcagcggctgcgcgaacgggagttggctgccgggaatcagtgctcacttccttctgaattgggcgtgtgcagtcggttcctagggaagtgctctgctgcagccaccagatttaacggatgctgctctctagcacttaacatagaagctaaactacctggcgttaaaattaattccatgagcataaggacatttgtcctatcccctattctgctgttgaattaatgactggaaaacattgcgcggaggtatttgggagtagtatggctttttttttttttttttttttaacagcaaatggtataaatctcaggtacaattcagtatcttcttcaccagttgttttttttcagcatgtattattactnccactnacggcctctgttgngcccttccttgctatgtnagcagccatntttaattctcagaacaatgtaatgagggtgcgcaaatgcacatgaagaaacaggtttccagacgtgaggcacctaactcagtccaacttgcacgaagctcgcattgaaaaccagatgtgactccgaagctaggttttttttctctcttgcctcactctcaatattgctgtcagttcctcctcaatctttaggtttgggcagggacaaagaatacatggattgttcctccacatgctgcaaacacattcacctaagcagagcacaggtagtgagatgagtagagagaactgaattagaggattctggatgtcagtctttgctgtcacttcttttggcttgtgctagaacagtggttcttacaagtgtcacgtgatagacacattctaaggtcctatcccagacctacagaatcagaaattggtggtggggcccagcaagcgtgctcaaatttgagagcaggtagactacagggtagtttccgcatatacaaaaggtgttttaattcttgctgtcagtctcagaagtttcatgctgagataaccaaatttaaatgataaaggtgcaagactgactcttaaaatcacattttttcaaattgccatagcttgctagtgttctcattcactgtgcttttacagcttcattttccactattttaagagaagaaattgctatgaagtgtatgtccaagtgaggaagttccctggtctgaggttgtttaaaacttacaataggccgggcacggtggctcaagcctgtaatcccagcactttgggaggccgaggtgggtggatcacgaggtcaggagttcaagaccaccctggccaacatggtgacaccctgtctctactaaggatacaaaattagccgggcatggtggcncacgcctgtagtcccagctacctaggaggctgaggcaggagaatagctggaacccgggaggcagaggttgcagtgagctgagactgtgccactgcactccagcctgggtgacagagcaagacttggtctcaaaaacaaaaaacaaaaaaaccaaacttggaatagcaagggctgcccattatttaaccttccacggcaattttaacagtggtattctgttccaagtggttaatattaaatccatgtgtcagtgttggtggctttcaaccntggctgcgcataatcattttgatgcttaggctacacccagccgagttatacagaatccctggagggtgggacctgatgagtgttttaatgtttcccgggtaattccaatggtagccaaggttaagaaccagtaccgtacgtacaaaaaagttgagaagctaatttcacgtacagaaaatttgccactgttccaagagcactctcaagcgacataattggcctctactcctattccctacaagtatgaatgggcaggagaagcatcacagagaaagcagagttagtgctggaacttgtatttttgtggatgatgaccttggttaatgttttttcataggctctgtttcataggctttgttttttcataggctctccctcattgcattgttctgagaattgaatgtggctgcttgcatggtaatgaggggttcaacggaggctgttggtggtagtgataatacaagctgaaaaactacacagacaaacctatcagtttctgcctcttcaggatataactattaggttggtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaagtattcctttta

SEQ ID NO: 317945 - DNA, 2171 bp, Homo sapiens
actctatctccagagcgggagccagacgccgacccaagcggaagtgacgttaggtgtccgccggaggtgtcgttggtgtgttgcgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaaaaaaaaaaaaaaaaaaaaaaaaaaaaaaaaaaaaaaaaaaaaaagggggggggggaaaaaaatacgaggggggacaatgagcagttttttggacaagggggcgcccccaataaagcgggacgcgctcaattaagaacgggggacgacggggccgcgataataacaacgagggcgagggcggaaaacactaccaacgcgggacacctatggagagcgaacccacaaacggggggggggggaaaataggtaggcacgactccgtcaagaaatgttacggcggaggggagactatcaaatggaggtggtaacagggggtacacgacggatatacaggtcgaagactgcccgaggattatgcgagaaatttgcgg

SEQ ID NO: 317946 - DNA, 5913 bp, Homo sapiens
  misc_feature (3195)..(3195): n is a, c, g, or t
  misc_feature (3752)..(3752): n is a, c, g, or t
  misc_feature (3758)..(3758): n is a, c, g, or t
  misc_feature (3772)..(3772): n is a, c, g, or t
  misc_feature (3790)..(3790): n is a, c, g, or t
  misc_feature (3800)..(3800): n is a, c, g, or t
  misc_feature (4682)..(4682): n is a, c, g, or t
  misc_feature (4952)..(4952): n is a, c, g, or t
ttacaaatgatagtaaaccaaagtgcaaaataacaacgtaaaaatgtcagtttaaaatgctgcacatggttgagctgctactaatcctgatgtttttttcttggggtgtggtgtgatctagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaataattttgtgaaaattcatgtttaagtagcaactaccctttctttttttatatatttttaaggtattagtttatcttcttctaactggtgcagtcacttaatgttttcattaatcttcgacctggagagtgaaatactgatatttctagaaaaaaattctactcctctgattatttgaaatgctgaggaaaatgtccctcccatagtaaaacttgtaaataaggaactatatcatattcagtagctgtgttctgttccatctttttttttttttttgagatggagttttgcttgttgcccaggctggagtgcagcggcacgatcttggttcactgcaacctccgcctcccaggttcaagcgattctcttgcctcagcctcccgagtagctggggactacaggtgtgcgacaccatgcctggctaatttttttgtatttttagtagagatggggtttcaccatgttggccaggctggtctcaaactcctgacctcaaaggatccacccgccttggcctcccaaagtgctgggatcacaggcgtgagccaccatgcccggcccatctttttttttttttttttttttaaagatgttaataaactttatacctttctggagactttgttctaaaatgtacataaatgctcatctagttaacatatttacttagaatgtgggaggaggagtcacattattatccctgaatctcaagtacagcagaagtgaattcctgggatagtaggatagactaacatgtaaaaaggccaggtgatgcataggttctcatttcactgccctcagccttcctctccttctgagctgtgccttctcacatgttcagtcaactccagggaatattgtctccatcttctggatagaactagttgcaggatccgttacaagaattcagagttttggcatctcccctttgtatgttgtaggagaaggtttggcattgaaaatgtgctgttgttccaaagaaaaattagcaaaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaatttattttatttttctgagatggagtcttgctctgttgcccaggctggagtgcagtggtgccatctcagctaactgcaacttccacttcccaggttcaagcgattctcctgccttagcctcccaagtagctgggactacaggcgcatgccagcatgcctggctaatttttgtatttttagtagagcgggggttttgccatgttggccaggctggtcttgaactcctgacctcaggtgatccgcctgccctggcctcccaaagtgctgggattacaggcatgagccactgcgcccagccttgtaatttacctttgatggtgacctgaaatgcagtatgatcctatatgtggcacgtagtaatgttcagtgtttgctgaattaattctgggcagcactaagaaatccctctttcccagtcatattctataacacatttcccatttgccacaaaacctgcagctttttggtccaggtaatgacatttgctgccattttgatgatttaaaaatggtcgtgggagttgaacatagtcatgaattcaggattcctgagcatgtagacagtcatcccagtggaaagacacgttcacttaagagaagtttaagttagaggaaacagtttatgctaaaaaaatttttagaaaagtccttgagaatttttgatttagtcttgacctcatgaagctggtagttatgatgtgcatagtttgtatcaccgtttatgaagatggagaatctagtcagcacgtgttggtttattctaggaatttttagggaacacttctgttgctggcaccaggtgatgaatatggttaaaaaaagactcgtttctgcctaaacatagggaagaagagcaaattaaaaggagtaattaaaactgataaaagctcaagttacctttgtgatgatgaggcgggcagttaacgcgaaagggttgggaaaggcttcctggagggactagggggcggtctaagcacagggaacctaaccggggactccagtgtggcacagcggcaaggtatgtgctgggcaaaatgataggtgtcttgggagaccaggcaaagagagctggattaggagccgttaagtatatatttttcttctttttaaataaaataatgcactgggtgaacatgtaaacgctaagttgaaaatctgcctttcccaggtaacccttgttaatctttctacaacttcatttcgtacaaacctgaaaaacacactgattttgtctttaaatgggcacacgctgcttacactcctcggcgcctagcctttctgaagccccacgcggccgtccctccagcattgaaggctggggcagcccagctcccctccagcgcccttacagccagaccgcggcggggtcgggccgcgcacgcgcagggcgnacggccggatctggggcgccgctgctccgggtggtcggaggtaggagtcccatcttgggtccagggccggtagagccccttaccgggggtagggagactgcgcacccgctagagccaactgtcagggcctgcagacgtcgggtgacgtcactgttacaaaattggcggtcacatcgtcttaagggccggtggcagcggctgcgcgaacgggagttggctgccgggaatcagtgctcacttccttctgaattgggcgtgtgcagtcggttcctagggaagtgctctgctgcagccaccagatttaacggatgctgctctctagcacttaacatagaagctaaactacctggcgttaaaattaattccatgagcataaggacatttgtcctatcccctattctgctgttgaattaatgactggaaaacattgcgcggaggtatttgggagtagtatggctttttttttttttttttttttaacagcaaatggtataaatctcaggtacaattcagtatcttcttcaccagttgttttttttcagcatgtattattactnccactnacggcctctgttgngcccttccttgctatgtnagcagccatntttaattctcagaacaatgtaatgagggtgcgcaaatgcacatgaagaaacaggtttccagacgtgaggcacctaactcagtccaacttgcacgaagctcgcattgaaaaccagatgtgactccgaagctaggttttttttctctcttgcctcactctcaatattgctgtcagttcctcctcaatctttaggtttgggcagggacaaagaatacatggattgttcctccacatgctgcaaacacattcacctaagcagagcacaggtagtgagatgagtagagagaactgaattagaggattctggatgtcagtctttgctgtcacttcttttggcttgtgctagaacagtggttcttacaagtgtcacgtgatagacacattctaaggtcctatcccagacctacagaatcagaaattggtggtggggcccagcaagcgtgctcaaatttgagagcaggtagactacagggtagtttccgcatatacaaaaggtgttttaattcttgctgtcagtctcagaagtttcatgctgagataaccaaatttaaatgataaaggtgcaagactgactcttaaaatcacattttttcaaattgccatagcttgctagtgttctcattcactgtgcttttacagcttcattttccactattttaagagaagaaattgctatgaagtgtatgtccaagtgaggaagttccctggtctgaggttgtttaaaacttacaataggccgggcacggtggctcaagcctgtaatcccagcactttgggaggccgaggtgggtggatcacgaggtcaggagttcaagaccaccctggccaacatggtgacaccctgtctctactaaggatacaaaattagccgggcatggtggcncacgcctgtagtcccagctacctaggaggctgaggcaggagaatagctggaacccgggaggcagaggttgcagtgagctgagactgtgccactgcactccagcctgggtgacagagcaagacttggtctcaaaaacaaaaaacaaaaaaaccaaacttggaatagcaagggctgcccattatttaaccttccacggcaattttaacagtggtattctgttccaagtggttaatattaaatccatgtgtcagtgttggtggctttcaaccntggctgcgcataatcattttgatgcttaggctacacccagccgagttatacagaatccctggagggtgggacctgatgagtgttttaatgtttcccgggtaattccaatggtagccaaggttaagaaccagtaccgtacgtacaaaaaagttgagaagctaatttcacgtacagaaaatttgccactgttccaagagcactctcaagcgacataattggcctctactcctattccctacaagtatgaatgggcaggagaagcatcacagagaaagcagagttagtgctggaacttgtatttttgtggatgatgaccttggttaatgttttttcataggctctgtttcataggctttgttttttcataggctctccctcattgcattgttctgagaattgaatgtggctgcttgcatggtaatgaggggttcaacggaggctgttggtggtagtgataatacaagctgaaaaactacacagacaaacctatcagtttctgcctcttcaggatataactattaggttggtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaagtattcctttta

SEQ ID NO: 317947 - DNA, 1515 bp, Homo sapiens
actctatctccagagcgggagccagacgccgacccaagcggaagtgacgttaggtgtccgccggaggtgtcgttggtgtgttgcgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcaggtgagtgttcagaacgtacccttgcacaggaactgtgggccattcccaaatcagcacttcctggtccaggcccaccctcccaataaccaaa

SEQ ID NO: 317948 - DNA, 131 bp, Homo sapiens
tcgattttctccagatggtcagtatttggtcactgggtctgttgatggattcattgaagtatggaactttactactggaaaaatcagaaaggtaaagtattttaaatgtgttaaccttcctagtggaaaaa

SEQ ID NO: 317949 - DNA, 284 bp, Homo sapiens
ccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggtaagagtggtggtgatgctgatccccatgggttggttcgttgtgggccagctccccaactaaaaagcgtcagtgagca

SEQ ID NO: 317950 - DNA, 1800 bp, Homo sapiens
actctatctccagagcgggagccagacgccgacccaagcggaagtgacgttaggtgtccgccggaggtgtcgttggtgtgttgcgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaa

SEQ ID NO: 317951 - DNA, 7153 bp, Homo sapiens
  misc_feature (31)..(31): n is a, c, g, or t
  misc_feature (4435)..(4435): n is a, c, g, or t
  misc_feature (4992)..(4992): n is a, c, g, or t
  misc_feature (4998)..(4998): n is a, c, g, or t
  misc_feature (5012)..(5012): n is a, c, g, or t
  misc_feature (5030)..(5030): n is a, c, g, or t
  misc_feature (5040)..(5040): n is a, c, g, or t
  misc_feature (5922)..(5922): n is a, c, g, or t
  misc_feature (6192)..(6192): n is a, c, g, or t
actctagaggttccccgactagtcaaccatncggagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaataattttgtgaaaattcatgtttaagtagcaactaccctttctttttttatatatttttaaggtattagtttatcttcttctaactggtgcagtcacttaatgttttcattaatcttcgacctggagagtgaaatactgatatttctagaaaaaaattctactcctctgattatttgaaatgctgaggaaaatgtccctcccatagtaaaacttgtaaataaggaactatatcatattcagtagctgtgttctgttccatctttttttttttttttgagatggagttttgcttgttgcccaggctggagtgcagcggcacgatcttggttcactgcaacctccgcctcccaggttcaagcgattctcttgcctcagcctcccgagtagctggggactacaggtgtgcgacaccatgcctggctaatttttttgtatttttagtagagatggggtttcaccatgttggccaggctggtctcaaactcctgacctcaaaggatccacccgccttggcctcccaaagtgctgggatcacaggcgtgagccaccatgcccggcccatctttttttttttttttttttttaaagatgttaataaactttatacctttctggagactttgttctaaaatgtacataaatgctcatctagttaacatatttacttagaatgtgggaggaggagtcacattattatccctgaatctcaagtacagcagaagtgaattcctgggatagtaggatagactaacatgtaaaaaggccaggtgatgcataggttctcatttcactgccctcagccttcctctccttctgagctgtgccttctcacatgttcagtcaactccagggaatattgtctccatcttctggatagaactagttgcaggatccgttacaagaattcagagttttggcatctcccctttgtatgttgtaggagaaggtttggcattgaaaatgtgctgttgttccaaagaaaaattagcaaaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaatttattttatttttctgagatggagtcttgctctgttgcccaggctggagtgcagtggtgccatctcagctaactgcaacttccacttcccaggttcaagcgattctcctgccttagcctcccaagtagctgggactacaggcgcatgccagcatgcctggctaatttttgtatttttagtagagcgggggttttgccatgttggccaggctggtcttgaactcctgacctcaggtgatccgcctgccctggcctcccaaagtgctgggattacaggcatgagccactgcgcccagccttgtaatttacctttgatggtgacctgaaatgcagtatgatcctatatgtggcacgtagtaatgttcagtgtttgctgaattaattctgggcagcactaagaaatccctctttcccagtcatattctataacacatttcccatttgccacaaaacctgcagctttttggtccaggtaatgacatttgctgccattttgatgatttaaaaatggtcgtgggagttgaacatagtcatgaattcaggattcctgagcatgtagacagtcatcccagtggaaagacacgttcacttaagagaagtttaagttagaggaaacagtttatgctaaaaaaatttttagaaaagtccttgagaatttttgatttagtcttgacctcatgaagctggtagttatgatgtgcatagtttgtatcaccgtttatgaagatggagaatctagtcagcacgtgttggtttattctaggaatttttagggaacacttctgttgctggcaccaggtgatgaatatggttaaaaaaagactcgtttctgcctaaacatagggaagaagagcaaattaaaaggagtaattaaaactgataaaagctcaagttacctttgtgatgatgaggcgggcagttaacgcgaaagggttgggaaaggcttcctggagggactagggggcggtctaagcacagggaacctaaccggggactccagtgtggcacagcggcaaggtatgtgctgggcaaaatgataggtgtcttgggagaccaggcaaagagagctggattaggagccgttaagtatatatttttcttctttttaaataaaataatgcactgggtgaacatgtaaacgctaagttgaaaatctgcctttcccaggtaacccttgttaatctttctacaacttcatttcgtacaaacctgaaaaacacactgattttgtctttaaatgggcacacgctgcttacactcctcggcgcctagcctttctgaagccccacgcggccgtccctccagcattgaaggctggggcagcccagctcccctccagcgcccttacagccagaccgcggcggggtcgggccgcgcacgcgcagggcgnacggccggatctggggcgccgctgctccgggtggtcggaggtaggagtcccatcttgggtccagggccggtagagccccttaccgggggtagggagactgcgcacccgctagagccaactgtcagggcctgcagacgtcgggtgacgtcactgttacaaaattggcggtcacatcgtcttaagggccggtggcagcggctgcgcgaacgggagttggctgccgggaatcagtgctcacttccttctgaattgggcgtgtgcagtcggttcctagggaagtgctctgctgcagccaccagatttaacggatgctgctctctagcacttaacatagaagctaaactacctggcgttaaaattaattccatgagcataaggacatttgtcctatcccctattctgctgttgaattaatgactggaaaacattgcgcggaggtatttgggagtagtatggctttttttttttttttttttttaacagcaaatggtataaatctcaggtacaattcagtatcttcttcaccagttgttttttttcagcatgtattattactnccactnacggcctctgttgngcccttccttgctatgtnagcagccatntttaattctcagaacaatgtaatgagggtgcgcaaatgcacatgaagaaacaggtttccagacgtgaggcacctaactcagtccaacttgcacgaagctcgcattgaaaaccagatgtgactccgaagctaggttttttttctctcttgcctcactctcaatattgctgtcagttcctcctcaatctttaggtttgggcagggacaaagaatacatggattgttcctccacatgctgcaaacacattcacctaagcagagcacaggtagtgagatgagtagagagaactgaattagaggattctggatgtcagtctttgctgtcacttcttttggcttgtgctagaacagtggttcttacaagtgtcacgtgatagacacattctaaggtcctatcccagacctacagaatcagaaattggtggtggggcccagcaagcgtgctcaaatttgagagcaggtagactacagggtagtttccgcatatacaaaaggtgttttaattcttgctgtcagtctcagaagtttcatgctgagataaccaaatttaaatgataaaggtgcaagactgactcttaaaatcacattttttcaaattgccatagcttgctagtgttctcattcactgtgcttttacagcttcattttccactattttaagagaagaaattgctatgaagtgtatgtccaagtgaggaagttccctggtctgaggttgtttaaaacttacaataggccgggcacggtggctcaagcctgtaatcccagcactttgggaggccgaggtgggtggatcacgaggtcaggagttcaagaccaccctggccaacatggtgacaccctgtctctactaaggatacaaaattagccgggcatggtggcncacgcctgtagtcccagctacctaggaggctgaggcaggagaatagctggaacccgggaggcagaggttgcagtgagctgagactgtgccactgcactccagcctgggtgacagagcaagacttggtctcaaaaacaaaaaacaaaaaaaccaaacttggaatagcaagggctgcccattatttaaccttccacggcaattttaacagtggtattctgttccaagtggttaatattaaatccatgtgtcagtgttggtggctttcaaccntggctgcgcataatcattttgatgcttaggctacacccagccgagttatacagaatccctggagggtgggacctgatgagtgttttaatgtttcccgggtaattccaatggtagccaaggttaagaaccagtaccgtacgtacaaaaaagttgagaagctaatttcacgtacagaaaatttgccactgttccaagagcactctcaagcgacataattggcctctactcctattccctacaagtatgaatgggcaggagaagcatcacagagaaagcagagttagtgctggaacttgtatttttgtggatgatgaccttggttaatgttttttcataggctctgtttcataggctttgttttttcataggctctccctcattgcattgttctgagaattgaatgtggctgcttgcatggtaatgaggggttcaacggaggctgttggtggtagtgataatacaagctgaaaaactacacagacaaacctatcagtttctgcctcttcaggatataactattaggttggtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaagtattcctttta

SEQ ID NO: 317952 - DNA, 6352 bp, Homo sapiens
  misc_feature (3634)..(3634): n is a, c, g, or t
  misc_feature (4191)..(4191): n is a, c, g, or t
  misc_feature (4197)..(4197): n is a, c, g, or t
  misc_feature (4211)..(4211): n is a, c, g, or t
  misc_feature (4229)..(4229): n is a, c, g, or t
  misc_feature (4239)..(4239): n is a, c, g, or t
  misc_feature (5121)..(5121): n is a, c, g, or t
  misc_feature (5391)..(5391): n is a, c, g, or t
atgattttgatcagatatctaggaaggtgcaggtttagaaatttggtgtctcgatatccaaggacatttcagtaagaatagaatttctcatatgaccagagaggcgcttaaagactgggacggaaatgaaaaataaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgcttttttttttttttgccagcttttctaagcaaatagattgtctgaattagtcacagaataattttgtgaaaattcatgtttaagtagcaactaccctttctttttttatatatttttaaggtattagtttatcttcttctaactggtgcagtcacttaatgttttcattaatcttcgacctggagagtgaaatactgatatttctagaaaaaaattctactcctctgattatttgaaatgctgaggaaaatgtccctcccatagtaaaacttgtaaataaggaactatatcatattcagtagctgtgttctgttccatctttttttttttttttgagatggagttttgcttgttgcccaggctggagtgcagcggcacgatcttggttcactgcaacctccgcctcccaggttcaagcgattctcttgcctcagcctcccgagtagctggggactacaggtgtgcgacaccatgcctggctaatttttttgtatttttagtagagatggggtttcaccatgttggccaggctggtctcaaactcctgacctcaaaggatccacccgccttggcctcccaaagtgctgggatcacaggcgtgagccaccatgcccggcccatctttttttttttttttttttttaaagatgttaataaactttatacctttctggagactttgttctaaaatgtacataaatgctcatctagttaacatatttacttagaatgtgggaggaggagtcacattattatccctgaatctcaagtacagcagaagtgaattcctgggatagtaggatagactaacatgtaaaaaggccaggtgatgcataggttctcatttcactgccctcagccttcctctccttctgagctgtgccttctcacatgttcagtcaactccagggaatattgtctccatcttctggatagaactagttgcaggatccgttacaagaattcagagttttggcatctcccctttgtatgttgtaggagaaggtttggcattgaaaatgtgctgttgttccaaagaaaaattagcaaaggacttgagatttagaaaagtctcctttgtaatgtgcatcattaccagttatctaaagaaaaacatgtaaaagccaacaaaacccttgaaaatattttgcatatggatgtctgtttcacgtttcaactgaagatgtatagagcacctctgatgatgaggaagataccatgctaggcagtactttcaagaacgtgagttcttatttctgcaggccttttgtgcccccttttaaatgttagcatttattaggtacaaactagtggggaaggtttttttaaaaagttttgcagtcttgtaatttacctttttaaaaaatttattttatttttctgagatggagtcttgctctgttgcccaggctggagtgcagtggtgccatctcagctaactgcaacttccacttcccaggttcaagcgattctcctgccttagcctcccaagtagctgggactacaggcgcatgccagcatgcctggctaatttttgtatttttagtagagcgggggttttgccatgttggccaggctggtcttgaactcctgacctcaggtgatccgcctgccctggcctcccaaagtgctgggattacaggcatgagccactgcgcccagccttgtaatttacctttgatggtgacctgaaatgcagtatgatcctatatgtggcacgtagtaatgttcagtgtttgctgaattaattctgggcagcactaagaaatccctctttcccagtcatattctataacacatttcccatttgccacaaaacctgcagctttttggtccaggtaatgacatttgctgccattttgatgatttaaaaatggtcgtgggagttgaacatagtcatgaattcaggattcctgagcatgtagacagtcatcccagtggaaagacacgttcacttaagagaagtttaagttagaggaaacagtttatgctaaaaaaatttttagaaaagtccttgagaatttttgatttagtcttgacctcatgaagctggtagttatgatgtgcatagtttgtatcaccgtttatgaagatggagaatctagtcagcacgtgttggtttattctaggaatttttagggaacacttctgttgctggcaccaggtgatgaatatggttaaaaaaagactcgtttctgcctaaacatagggaagaagagcaaattaaaaggagtaattaaaactgataaaagctcaagttacctttgtgatgatgaggcgggcagttaacgcgaaagggttgggaaaggcttcctggagggactagggggcggtctaagcacagggaacctaaccggggactccagtgtggcacagcggcaaggtatgtgctgggcaaaatgataggtgtcttgggagaccaggcaaagagagctggattaggagccgttaagtatatatttttcttctttttaaataaaataatgcactgggtgaacatgtaaacgctaagttgaaaatctgcctttcccaggtaacccttgttaatctttctacaacttcatttcgtacaaacctgaaaaacacactgattttgtctttaaatgggcacacgctgcttacactcctcggcgcctagcctttctgaagccccacgcggccgtccctccagcattgaaggctggggcagcccagctcccctccagcgcccttacagccagaccgcggcggggtcgggccgcgcacgcgcagggcgnacggccggatctggggcgccgctgctccgggtggtcggaggtaggagtcccatcttgggtccagggccggtagagccccttaccgggggtagggagactgcgcacccgctagagccaactgtcagggcctgcagacgtcgggtgacgtcactgttacaaaattggcggtcacatcgtcttaagggccggtggcagcggctgcgcgaacgggagttggctgccgggaatcagtgctcacttccttctgaattgggcgtgtgcagtcggttcctagggaagtgctctgctgcagccaccagatttaacggatgctgctctctagcacttaacatagaagctaaactacctggcgttaaaattaattccatgagcataaggacatttgtcctatcccctattctgctgttgaattaatgactggaaaacattgcgcggaggtatttgggagtagtatggctttttttttttttttttttttaacagcaaatggtataaatctcaggtacaattcagtatcttcttcaccagttgttttttttcagcatgtattattactnccactnacggcctctgttgngcccttccttgctatgtnagcagccatntttaattctcagaacaatgtaatgagggtgcgcaaatgcacatgaagaaacaggtttccagacgtgaggcacctaactcagtccaacttgcacgaagctcgcattgaaaaccagatgtgactccgaagctaggttttttttctctcttgcctcactctcaatattgctgtcagttcctcctcaatctttaggtttgggcagggacaaagaatacatggattgttcctccacatgctgcaaacacattcacctaagcagagcacaggtagtgagatgagtagagagaactgaattagaggattctggatgtcagtctttgctgtcacttcttttggcttgtgctagaacagtggttcttacaagtgtcacgtgatagacacattctaaggtcctatcccagacctacagaatcagaaattggtggtggggcccagcaagcgtgctcaaatttgagagcaggtagactacagggtagtttccgcatatacaaaaggtgttttaattcttgctgtcagtctcagaagtttcatgctgagataaccaaatttaaatgataaaggtgcaagactgactcttaaaatcacattttttcaaattgccatagcttgctagtgttctcattcactgtgcttttacagcttcattttccactattttaagagaagaaattgctatgaagtgtatgtccaagtgaggaagttccctggtctgaggttgtttaaaacttacaataggccgggcacggtggctcaagcctgtaatcccagcactttgggaggccgaggtgggtggatcacgaggtcaggagttcaagaccaccctggccaacatggtgacaccctgtctctactaaggatacaaaattagccgggcatggtggcncacgcctgtagtcccagctacctaggaggctgaggcaggagaatagctggaacccgggaggcagaggttgcagtgagctgagactgtgccactgcactccagcctgggtgacagagcaagacttggtctcaaaaacaaaaaacaaaaaaaccaaacttggaatagcaagggctgcccattatttaaccttccacggcaattttaacagtggtattctgttccaagtggttaatattaaatccatgtgtcagtgttggtggctttcaaccntggctgcgcataatcattttgatgcttaggctacacccagccgagttatacagaatccctggagggtgggacctgatgagtgttttaatgtttcccgggtaattccaatggtagccaaggttaagaaccagtaccgtacgtacaaaaaagttgagaagctaatttcacgtacagaaaatttgccactgttccaagagcactctcaagcgacataattggcctctactcctattccctacaagtatgaatgggcaggagaagcatcacagagaaagcagagttagtgctggaacttgtatttttgtggatgatgaccttggttaatgttttttcataggctctgtttcataggctttgttttttcataggctctccctcattgcattgttctgagaattgaatgtggctgcttgcatggtaatgaggggttcaacggaggctgttggtggtagtgataatacaagctgaaaaactacacagacaaacctatcagtttctgcctcttcaggatataactattaggttggtgcaaaagtaattgcggtttttgccattaaaagtaatggcacattacttttgcaccaaccgacctaatatgactttcttttagtgttcttaggatttttaattgtaaaacatgtaacaaattttcctaaacaattgtgcaattcagtggcattatttacgatgttacgcaaccactattgtatttccaaaatgtcatcaccctaaacagaagccctgtaacattgtcaattaacttctccttcccttcccctcagcctttggtactgtttctgcctcaatgcatttgtctaagtttagttcatataagtgaaattatacaatacttgtccttttttatctggcttatttcatttagcatgttttaaaggttcatccatgtatcaaacagtaaagtgcttcatatttgggggaagtataaaaagtattcctttta

SEQ ID NO: 317953 - DNA, 1810 bp, Homo sapiens
actctatctccagagcgggagccagacgccgacccaagcggaagtgacgttaggtgtccgccggaggtgtcgttggtgtgttgcgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagctgtcaaagatgtggaagaagaaaagtttcctacacaactgagcaggcatattaagtttggtcagaaatcacatgtggagtgtgctcgattttctccagatggtcagtatttggtcactgggtctgttgatggattcattgaagtatggaactttactactggaaaaatcagaaaggatcttaagtaccaggcccaagataactttatgatgatggatgatgctgtcctctgcatgtgtttcagcagagatacagaaatgttagcaactggggcccaagatggaaaaatcaaggtgtggaagattcagagtggacaatgtttaaggagatttgagagggcacacagtaagggtgtcacctgtctaagcttttctaaggatagcagtcagatccttagtgcttcttttgaccagacaattagaattcatggtttaaaatctgggaaaaccctgaaggaatttcgtggccattcctcctttgttaacgaagcaacatttacacaagatggacattacattattagtgcatcctctgatggcactgtaaagatctggaatatgaagaccacagaatgttcaaatacctttaaatccctgggcagcaccgcagggacagatattaccgtcaacagtgtgattctacttcctaaaaaccctgagcactttgtggtgtgcaacagatcaaacacggtggtcatcatgaacatgcaggggcagattgtcagaagcttcagttctggtaaaagagaaggtggggactttgtttgctgtgccctctctccccgtggtgaatggatctactgtgtaggggaggactttgtgctctactgtttcagtacagtcactggcaaactggagagaactttgacagtgcacgagaaggatgtgattggtattgcacatcaccctcatcagaacctgattgctacctacagtgaagatggactcctaaagctctggaaaccataattcaacttttctttttaaatcagctcgaaagcatgtacttaaatgaagcatattcatgtaatgtgctttttttttttttttttttttttttttttttttttttttttttttttttttgttgggcgggggggggg

SEQ ID NO: 317954 - DNA, 732 bp, Homo sapiens
actctatctccagagcgggagccagacgccgacccaagcggaagtgacgttaggtgtccgccggaggtgtcgttggtgtgttgcgcgactggccttgagggagagctggggcctgctcccggagagatacggctatgtcgatcgaaatcgaatcttcggatgtgatccgccttattatgcagtacttgaaggagaacagtttacatcgggcgttagccaccttgcaggaggagactactgtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcctcgtgaggcatacccagatggaagtagcaaagaaaagagaagagcagcaattgcccaggccttagctggcgaagtcagtgtggtgcctccatctcgtctcatggcattgctgggacaggcactgaagtggcagcagcatcagggattgcttcctcctggtatgaccatagatttgtttcgaggcaaggcagcaccaccaatacgggggatcctct

SEQ ID NO: 317955 - DNA, 992 bp, Homo sapiens
ggtcacactcctctgtgacacgcgaggctcctcagttacttagccaacggcagaggcgggaagtgagaggagtctggggctggggctgccttccaggcccacggggcggcccgctcttttcggatggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaa

SEQ ID NO: 317956 - DNA, 432 bp, Homo sapiens
ggtaccccagacttctgactcggccaccatggggccagtcctgcagatacagtctcatgttccagttactcaggacacaccccgtcgggtggagcgctccacccgacggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagtcgggtggagcggggtcctctagatcgacacagcgacac

SEQ ID NO: 317957 - DNA, 1032 bp, Homo sapiens
gaatgtgttgcacaaattgggccttatggcgggtttgtgtccccccactgttgggggcccctgtccccgagatttgggggctaacaatgtgggggtgacaactcattatggggttttcaccagaagacttgtccttggggttcaacaacagaacaggattacccccgcaggggggtcactttttggggaattgtttttgcgtctttttgaggtggtgtttccagtggctttccacgggtgacagagttcggagccgccttgtaggggttccttattcccgtattgggccacttaattgtttgggcgttttcccctaatttgcagccaaccccggggcgccacgtctgtgtgcacacccgtgggcgccctccgggtgtcacacccggggcacccccaggtccactgtgggtacatccttggaaaatctacctttggtgttgaaaaggtgtgttctaatttcccggaggggaaacaggcccaccccgcgatgggctcacacacttcaccgaaggaattcctgctcctttgagaatttatctgctggcctcccacgacctctctggcttttagaaactctatttaaaaggcaccttccttcctcgctttaacaccccgcgtgtaaacttgtccccaaaaattgtggggagattttctctggctaaggcctcataagaattttgtagggtacacatctctcttgtgaagcccaaatccaccccttttgtgcgcttctttgcctgtggaatataatgggtgtttttcctttatggaacccctgcccacagagaatagacaccacagagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317958 - DNA, 809 bp, Homo sapiens
  misc_feature (586)..(586): n is a, c, g, or t
tttctcacttggtgcctcggtgcataaaaaagttttctgtataacataattctctctttgtggtagccaatgtttttttatcgcccgtccacctatatttagtcccactgtcttctgttgttaacaccccatattattcacccccttacaaacgttttagtaattttttcccctcttatagtgcgttgtattatacttctctgtcaggagagtgagtttttcttccccccaacatattgtttcttccccctcccccccaatgatagatagtggtgtgctgcctttttcccacacagatgttgtctcctccgtgttgccgcttctgttgtcccaccttcttcccccgtttatgttgtatccagctgcgccgcccctcgcctccctgtttataattaataggccccccctctatttgtgggcgcccccccttcttctatccaaagataatgctcggctgctccgctgcctatttaggtggtgccctcccctggaggagcttctcttttcccccccccccccttttttttttttttttttttttttttttttttttttttttttttttttttttttttttttttttttnaaggttaaggaattttctttattttttacaaattaagactatgcaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317959 - DNA, 771 bp, Homo sapiens
  misc_feature (586)..(586): n is a, c, g, or t
tttctcacttggtgcctcggtgcataaaaaagttttctgtataacataattctctctttgtggtagccaatgtttttttatcgcccgtccacctatatttagtcccactgtcttctgttgttaacaccccatattattcacccccttacaaacgttttagtaattttttcccctcttatagtgcgttgtattatacttctctgtcaggagagtgagtttttcttccccccaacatattgtttcttccccctcccccccaatgatagatagtggtgtgctgcctttttcccacacagatgttgtctcctccgtgttgccgcttctgttgtcccaccttcttcccccgtttatgttgtatccagctgcgccgcccctcgcctccctgtttataattaataggccccccctctatttgtgggcgcccccccttcttctatccaaagataatgctcggctgctccgctgcctatttaggtggtgccctcccctggaggagcttctcttttcccccccccccccttttttttttttttttttttttttttttttttttttttttttttttttttttttttttttttttttnaaggttaaggaattttctttattttttacaaattaagactatgcgctcaggctgcattctaactcatactgtgaagacaaaggtgtttttgattcagaaatatatgaaatctgcatagtcttaatttgtaaaaaataaagaaaattccttaacctttgcggacgcgtgggtcgcccacgcgtccg

SEQ ID NO: 317960 - DNA, 2098 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317961 - DNA, 2567 bp, Homo sapiens
ttgggatttgaagttgttgcccatttatccatccatccatccatccagtcatccatccacccatccactcacccacccatctatccacccaactacccattcactcactcttccactcacctgtctacccatccacccattcttccatccatccatccacctgtccacccaacttctcatccacttatccatctactcacccatccatctaccctccacttatccattcatccatccttccaccccgtcgggtggagcgctccacccgacggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317962 - DNA, 2347 bp, Homo sapiens
gcaggcagctgatgctgatgtcgaatctagaggtccccgctccacccgacggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317963 - DNA, 2103 bp, Homo sapiens
aattcaagcttctaacgatgtacggggacatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317964 - DNA, 2541 bp, Homo sapiens
gtcatgacggatcattactgcaccatctggcctgacccttacctggaatctagaatcactggtatatagaagacgacgacgaggaagaggaggagctggaatctgagctggagctggaagcgctaaggcgtagacactgctactagctgtagcagaggatgactctgtattctcattcgctttcttggggggctttttagtagaattgagctgtccgctgacatcttgtaaccgcttttctaattcccgctttttctccaaagccagttcctcctttgtctttcccacaggcttcttaatggtgtagggcttccggggtttcttacgtaggcaggaaaggacatagcgctcaagctctctaagtgtggatggcttgagtgtatcaaaatcaatctcaatctcttctgggtttgaatcacgttaagagggctccctggcttggattatatgcacaactcggcccagcttctccccaggtaatttgttgatgtccaggctcagctgccgcttctcatcgtaactcatgggcgacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317965 - DNA, 2043 bp, Homo sapiens
atgtgaggtgactctcaggatcttatcggcggacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317966 - DNA, 2217 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttaaaaaaaaaaaaaaatcaaactagtttgttttagggggggcccgggacctaattaaacctatgttgggtgatggcaaattaatgggcgtcttttaccaacgtggaactggggagacctt

SEQ ID NO: 317967 - DNA, 2224 bp, Homo sapiens
tgcacacgccgaggacccacatccgaaggccacactgcacacgccggactcgcggcggtggtaactcggaggtcactgtggacgaagttgttgctgcacacgccgaaggccctaacaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattacctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317968 - DNA, 2500 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttaaaaaaaaaaaaagcatacacacatatcaaaaaagaaaacaacgaatataacacacaagagaatgaacagaacaagccagacaacaaggccaacagcgcgagccaaaccaacaacaagaacgcccgcagcacacccaaaataccaccatgagcggcaggaagcaagatgcacgcatacagctcaactagtatagaacccgacgacaccgccagtactatgaacctaaacaaaccagcgagcagcagcaaacaaaccaccgggaggaagcaccaaacactcaccgtattgaggagacgacacacgcatgacaggcataacacatggacccagacacaatgaacccacgcgaacacgaccacccggatctgcaagagacgtctatagaaatagacaaccacaac

SEQ ID NO: 317969 - DNA, 2452 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttaaaaaaaaaaaaaaaaaaaaaaaaaaaaaaaaaaaaaaaaaaaaaaaaaaaaaaaaaaaaaaaaagaaaaaaagagaagaagggaaaaaggaaaaagataaaagaaagaaggaaggaggagttaatgagatggtacagtgtagtatagtaagatgggttaggtgatgaggtgagatagaaggtagctaaacctaggtgtaaggtaatcgtggaggaaagtagtggggtgaggaacgattagtgaaggagggagaggatggttgggtagtgtgtggttttgttggaggggaaacgatttgtgtgatgtatatgggagaggaggaaactataagagtgaaaaaggtagggtggaaa

SEQ ID NO: 317970 - DNA, 2126 bp, Homo sapiens
  misc_feature (2112)..(2112): n is a, c, g, or t
  misc_feature (2126)..(2126): n is a, c, g, or t
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttaaaaaaaaaaaaangtcgacgcggccgn

SEQ ID NO: 317971 - DNA, 1758 bp, Homo sapiens
aggattccagtgcttactccacaaacagcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317972 - DNA, 1780 bp, Homo sapiens
acatacatacatagtaatcatttggaaactttcacagtaataataaacaccaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317973 - DNA, 1684 bp, Homo sapiens
  misc_feature (3)..(3): n is a, c, g, or t
ggnccgctctagagtatcccctccccgtacgcccaattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317974 - DNA, 2046 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaagggacacacgggatcctctagaat

SEQ ID NO: 317975 - DNA, 2032 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaaggctcaggctgcattctaactcatactgtgaagacaaaggtgtttttgattcagaaatatatgaaatctgcatagtcttaatttgtaaaaaataaagaaaattccttaaccttt

SEQ ID NO: 317976 - DNA, 2045 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317977 - DNA, 1268 bp, Homo sapiens
tactagtgagactggggtgaatcggcgagggccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317978 - DNA, 2047 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggaaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317979 - DNA, 1080 bp, Homo sapiens
ccaggtggtacggtccggaggttttgggatgcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317980 - DNA, 2413 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagattatagtatctctacactttccttcctagttctcgatttcaggtcaggtgcgatctacccatactgggaagccaaggtgttttgatcagaaaactttggatctgcatagcctaatttggaaaattaagaaattcttaaccttataaaaaatatacacgccgtcctggatttccgcaaacccacaaaataaaaaactgtgggcctcttggccaacgtttatcctcggagacttattttcggcctattggccaatggcccatgccctataggggggtacaaaactgggccgcttaaagatggctgtgaaacccggttcccattaatgcgttggaaacccttttcacggggcgaatcgaaggccccctatgctctcaaattggcctcttagctcgggaattggcggcttttttaaaacgcgcgattcttcaacgctttttaaacaggcgaatccgacctctttacccctctacgcgggttcattctcaaaccctttgcgctccctccgggaatctcttgtggggcccttccctcctttttgtggcg

SEQ ID NO: 317981 - DNA, 1904 bp, Homo sapiens
  misc_feature (1875)..(1875): n is a, c, g, or t
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatcagnatgatgaatcgcaccactgccctccagcc

SEQ ID NO: 317982 - DNA, 1973 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagttttgaaccgcgccacgactgactcgacatttacactctcctccgaagcacccctcatactccctacttttaaggccaactccctcagatttttacactggctacctctccctctcctttccccgtccctcgtgccg

SEQ ID NO: 317983 - DNA, 1879 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagttagtaacgcctgtagaatcaggccagattcattctttctgct

SEQ ID NO: 317984 - DNA, 1751 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaactccctaaacgagggtaccggagctcga

SEQ ID NO: 317985 - DNA, 846 bp, Homo sapiens
caggttcccgctcggtagctgtactaaccctgtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317986 - DNA, 1627 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgaaactgattgggatcctctagaacacca

SEQ ID NO: 317987 - DNA, 1939 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttctttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317988 - DNA, 1734 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317989 - DNA, 1505 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaagggtaagactggtaccgactcgat

SEQ ID NO: 317990 - DNA, 1532 bp, Homo sapiens
aggctaggaggaggccgggggcggcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 317991 - DNA, 1608 bp, Homo sapiens
  misc_feature (15)..(15): n is a, c, g, or t
  misc_feature (1608)..(1608): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacaggtaaggaaggctgctaggggtaaggaaattggggccgactn

SEQ ID NO: 317992 - DNA, 1595 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttc

SEQ ID NO: 317993 - DNA, 2577 bp, Homo sapiens
  misc_feature (15)..(15): n is a, c, g, or t
ggggagcggaagtgngcggggagagcacatccggtgttagaagcgctggtaggccttggagaggcgggttaggaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 317994 - DNA, 1307 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagaagggtaaggctggtaccgagcc

SEQ ID NO: 317995 - DNA, 2245 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 317996 - DNA, 2196 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 317997 - DNA, 2513 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcatcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 317998 - DNA, 1241 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgcactgaaggactattaggattgctgcctcctaagttatcacagcctcg

SEQ ID NO: 317999 - DNA, 1306 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagggtttttccagtgaagaacatctgatagacaaatgtcaatgtaaagattgaactatagcagggctactctacatgagtgccctagaatacagagcgatatttaatggataattggaatcatgtgtgagcacgggatatgtagatcaa

SEQ ID NO: 318000 - DNA, 1203 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcatccgcaggggtttcccacgggagacccgtagagattctcaagccagtgacacggggaagtgctacgatcatgattacga

SEQ ID NO: 318001 - DNA, 927 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaa

SEQ ID NO: 318002 - DNA, 1102 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgctgcaggtacccctctacttctatat

SEQ ID NO: 318003 - DNA, 1042 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgtgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 318004 - DNA, 1486 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaagataaacaaggcatcatggatttccctgttccagtcctttcaaatgcctccatctcagtgtgcagctttccaaggaggctgtccagcgttgttgtctatcaagctggatcgaggaagccactgtaagcctcaagaaccctgcgggaacaattggtgaattggggcctgtatccaaattgcaacaaaccaatgacttataattggacccggttcttgggagaaccttggtatgaaaaatgggccaaaacaaagaagggcccctttgggagagttccttctacctagttgggcgaacttggaagacctttggctttggcgacccccgtggaagacacttgtgtccttatcgataacaaacacttcaacaaccttgggatccaagcgttgtgtatcatacacgcttagtactgttataggggtagtatatacacccgcaagagccccaacttattaaacctttccaatgggagcaacccgacatcagttgtatttcgttattcgctgaacatactctatctggagtcgacttcatgtaccaacttgagcgactaacatacaa

SEQ ID NO: 318005 - DNA, 951 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaaaaaaaaatagtaaagaaagcat

SEQ ID NO: 318006 - DNA, 980 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 318007 - DNA, 1070 bp, Homo sapiens
  misc_feature (1056)..(1056): n is a, c, g, or t
  misc_feature (1070)..(1070): n is a, c, g, or t
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgtgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttaaaaaaaaaaaaangtcgacgcggccgn

SEQ ID NO: 318008 - DNA, 1180 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcatctatagtctcatgatttagctgctcactgacacagagtaggcagcagaattcggagagatatgtcattctgtgactagttggctgactgttcagaatgtgcttagcgagtagcacacaggagccatctgt

SEQ ID NO: 318009 - DNA, 755 bp, Homo sapiens
caggttcccgctcggtagctgtactaaccctgtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgtaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 318010 - DNA, 750 bp, Homo sapiens
atccccgagcctaagggctacccaaagaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacgctcaggctgcattctaactcatactgtgaagacaaaggtgtttttgattcagaaatatatgaaatctgcatagtcttaatttgtaaaaaataaagaaaattccttaaccttt

SEQ ID NO: 318011 - DNA, 605 bp, Homo sapiens
ttgggatttgaagttgttgcccatttatccatccatccatccatccagtcatccatccacccatccactcacccacccatctatccacccaactacccattcactcactcttccactcacctgtctacccatccacccattcttccatccatccatccacctgtccacccaacttctcatccacttatccatctactcacccatccatctaccctccacttatccattcatccatccttccaccccgtcgggtggagcgctccacccgacggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattaagccagcccccctcccccactcgactcggcggccacccccacgggtcgag

SEQ ID NO: 318012 - DNA, 1052 bp, Homo sapiens
  misc_feature (15)..(15): n is a, c, g, or t
  misc_feature (937)..(937): n is a, c, g, or t
  misc_feature (939)..(939): n is a, c, g, or t
  misc_feature (963)..(963): n is a, c, g, or t
  misc_feature (988)..(988): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggccactgccaactaattgccaatatttgcccctcccctttaataaagcttttaagaagtcacattattggaaaacttaacttcaacatttggcctactcaagctcttctgaagttctcctgagatgactgaatatgaaccaaagctgcactgtgctgtacttttcagcttcaactgggaatactcttccaaggataaaagcagctccagtccctgaaggtgttcgtgccaacagcacagcggtacactccttctctaacccagtttgtcaatagtactatagcatctgtggaaaatcttagaaaaaaacattttctcncncaccctctctcttccctgttaagnccatcccaaaatgcttcaagtaaanaataacaagtttaaggggttaagcacttttaaagtctgattaagggggtggggggaaaaaagag

SEQ ID NO: 318013 - DNA, 2267 bp, Homo sapiens
tgcacacgccgaggacccacatccgaaggccacactgcacacgccggactcgcggcggtggtaactcggaggtcactgtggacgaagttgttgctgcacacgccgaaggccctaacaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 318014 - DNA, 1809 bp, Homo sapiens
aaaattaggctagtacgaggcgggggtgaatcggcagaggcgcacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 318015 - DNA, 2413 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 318016 - DNA, 2478 bp, Homo sapiens
ggtcacactcctctgtgacacgcgaggctcctcagttacttagccaacggcagaggcgggaagtgagaggagtctggggctggggctgccttccaggcccacggggcggcccgctcttttcggatggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 318017 - DNA, 2530 bp, Homo sapiens
  misc_feature (15)..(15): n is a, c, g, or t
ggggagcggaagtgngcggggagagcacatccggtgttagaagcgctggtaggccttggagaggcgggttaggaagagacagggtttcgccgtgttggccagactggtctcgaactcctgacgtcaaagtgatccacctgcctcggcctcccaaagtactgggattacaggcgtgagccactgtgcccaacctagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 318018 - DNA, 2373 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgttttgaggatgctgtcctctgatttagctgctgcctccagcctctggcttgagaacttactaaaggc

SEQ ID NO: 318019 - DNA, 1277 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttc

SEQ ID NO: 318020 - DNA, 953 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaacaaagggtaagggtagcgagctcgat

SEQ ID NO: 318021 - DNA, 884 bp, Homo sapiens
  misc_feature (15)..(15): n is a, c, g, or t
ggggagcggaagtgngcggggagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggctacgaaagaacgacacgacattgcagtgaccatcagctttccaattagaattcctcttcttcaacctaattccttttggccctttc

SEQ ID NO: 318022 - DNA, 532 bp, Homo sapiens
ttgggatttgaagttgttgcccatttatccatccatccatccatccagtcatccatccacccatccactcacccacccatctatccacccaactacccattcactcactcttccactcacctgtctacccatccacccattcttccatccatccatccacctgtccacccaacttctcatccacttatccatctactcacccatccatctaccctccacttatccattcatccatccttccaccccgtcgggtggagcgctccacccgacggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctagagaggagaatgactcacctcgtggcgg

SEQ ID NO: 318023 - DNA, 564 bp, Homo sapiens
ctcaagcagtcctcctgtagctgggataacagatgcgtccagctggaatgtatagttttaaaaagctctcaggtaattgtgtaaaagcacacatagaagataatgacctagaagcctggtaatgtacctgtgtaatgacactagagttagaaaaagattgttctgcacttgatgtcctatgaccttggggaagttgcttgactctttggagtctgttttctgtaaaaagggattggtaatttctgccttgaatggtttccttggtatgctagaaagcaccattagtgtacctaacacccaaaccctcaaaactcccctcttgccatctctctgccctcctccttccctgtatcagctaaaagaagaggttcagagattaggcgggcctttcctgtgcactgaccaggcctcattaatagtctgggccctggctccagctgggccggctccttgtctttctcctaggggatttcttcactgctttcccttgtcattgcttcttggtggtaagcctatggaccttcagggcctgccaggcactagtcactcagcaagccaggacat

SEQ ID NO: 318024 - DNA, 1174 bp, Homo sapiens
  misc_feature (1)..(1): n is a, c, g, or t
  misc_feature (254)..(254): n is a, c, g, or t
nttagttgaacaaccattagtaatgctaaggatgaccaccgtgttaaagtgatgacaatctgcttctcattggacaattgtgctagaagcattatctcatcaaccattaacctaatcatttccagaactaataatttcattagagttgcagaatgaccaatgtctaattctgttactcctacattataattgacattcttctgtaaagagagccttccttcatcaactgaagctatttgggtattctcaaaggnaaattttacaaattttacaggaaaggaaagagaaatgcttaatttatttgtatttagttaccagttttctttttttttttttttttccaatttgagagcaggtactgtttattaaccaaccagcttagagaaatagtcatgggtagacaccttagttcattcttctaataagcctgttgatctggtcctccctgttgccagcatctccaccttctacaaaatgggtggtcttttttcttcattccacctcgtggagaagacaatttgaagggccacaggaagttatttgcctctttgaagcgttttccaacagtatagatctcatgaatcaaatcctccatgcagatgatgccgtatttaccaagagatcgagcaatcaaagcgttatctgtcaaagcaattcgcttcttattgattttgccataaccacgcttgtagattagttcatttactgacttcagattggggtacccccatgcaatatatggctctacaatcctcagcatgttaatcgaagccttgttgagcttcacaaaggttccattgaagatttgacgaaggcgaagaagctgcaacacctttcgaacctttgggctcactccattgatacctctgattctgatgacaaacgccaatttgggttctgcaggtacatagaagttgccagcttttcttgccatcctcgccattcgaatttcagttctgtacatctgcctatattccttgtgatagtgctttgctttttcatagataagcttcctccttgcctttcgaagcatcttttgggcaaacttctttctcaggcgcttgatcttcagctctgcgaaattccttcgctttttcttaagggtttctggcacagcaggaacctccttcttcttctcttctacaccctccatggttccagccggaaaaagagc

SEQ ID NO: 318025 - DNA, 1646 bp, Homo sapiens
aaaaaataaaataaaaaataaattgactgtctctggaccgctatctaataaggctgtcctgcattgctgacatcccgttcgctgtcagtctaaaagacccttgtgattcttggggctttaatggaccatttgttctgtctgtgctcttctttgccagcaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtg

SEQ ID NO: 318026 - DNA, 3817 bp, Homo sapiens
tgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtgaagaaacaaaaaaaggtcgacgcggccggaaatttagg

SEQ ID NO: 318027 - DNA, 2569 bp, Homo sapiens
caaaaggcactcttctatatctacacacacacagtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtg

SEQ ID NO: 318028 - DNA, 2060 bp, Homo sapiens
tgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgcgctggcctacagcacatgccgggatcctctaacgtcag

SEQ ID NO: 318029 - DNA, 2642 bp, Homo sapiens
tgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggtaggaaccttcattgaaagttgttggtgctttctcggtgtctggtgttatcagagggcatttacatatctagtacagtggctgtttttaaagatagtattttcaaactgtggattatgaggaatgtcaccaaaatcaaaggtcatgctccttgtcaattgtgtcatcccggtgtccagatgatgttttattcagtcacagcttacctcttccttaagcagacatctttctgaaaactgtggaaagtaagtccaggacttgagagaggggaagaatctcatgcggggacatgactgttgggagggagccaaagaaggagctcagcaggaataagcagctctatctgtgctacaattatggaagcagttgtgcaccacactaaaaatacctttatcaagccgggtgcagtggctcacacctgtaatcctagcactttgggaggccgagataggcaacagagagagaccccatctctacaaaaagaaaaaattagggccgggcgcggtggctcgagcgcctgtaatcccagcactttgggaggctgaggtgggcggatcacttgaggtcaggagcttgagagcagcctggccaacacggtgaaaccccgcctctactaaaaatacaaaaattagccgggcatggtgatagacgcctgtaatcccagctactctggaagctgaggcaggagaatcgcttgaacctggggcggaggttgcattgagccgcgattgcgccactgcgctccagcctgggtggcagagcgagactctgtctccaaaagaaaaagaaaaaattagctggggccaggcacggtgactcacacctgtaatccc

SEQ ID NO: 318030 - DNA, 3779 bp, Homo sapiens
tgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagccaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggattaacaagtg

SEQ ID NO: 318031 - DNA, 2504 bp, Homo sapiens
tgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtcagcaaattaaaacgtcacattcgctctcatactggagagcgtccgtttcagtgcagtttgtgcagttatgccagcagggacacatacaagctgaaaaggcacatgagaacccattcaggggaaaagccttatgaatgttatatttgtcatgctcggtttacccaaagtggtaccatgaagatgcacattttacagaagcacacagaaaatgtggccaaatttcactgtccccactgtgacacagtcatagcccgaaaaagtgatttgggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcggaataccatggcaagacatgctgataattgtgctggcccagatggcgtagagggggaaaatggaggagaaacgaagaagagtaaacgtggaagaaaaagaaagatgcgctctaagaaagaagattcctctgacagtgaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagcgtaagttgttcatctctgctctggaggctggcgtcttctccgagcatgtgggggagccagatgggtccttgttctttggggatgtgggaactaagccatgagaacaagttaagggcatgtcgagaacaaactctcaggaaatggctttttaggagtttttactgaggaacatctgaggaagtctttagaggcctgttacatttcaagaagaagt

SEQ ID NO: 318032 - DNA, 717 bp, Homo sapiens
tgtgtctgagcctgtggagcgattaaaccgtgcgcggagctgcttctttggcggcagcggcggcggcggtggccggtgcggacgcgcggagctcgccggagacgccgggtggccggagccgtggagcggcggcggagcgggcgccgcggggggtgtggcgcggagaatgattacggacctgaagccaaagaacaagatgcgctagtggacagattgctgaccaggggcttgagagctgggttctattttccctcctcaaactgactttgcagccacggagaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttccgcaaggccctctttagacacttcattttcataagccccctgaagttcttctactgaagtggtagcaacaggtacagtcacaggtacaggtacttgaacagctgaagttctcctatgtttatgggcttcctc

SEQ ID NO: 318033 - DNA, 1935 bp, Homo sapiens
tggttagagttacattcatctgcatgcatcagaaagtctaattctaatagcttaagcaaaaatatattttttcacataaaaaatagagaaacaaatgattgttgatatcagttcagtggctcagtgacatcagggccaatgactgttattctcttagcctgtccttcctatgattattgtagctccagctgttaagaccatattcaagttgggaaaaaagagaaaatgagaagggtcagagctgtatgaactaatctgtctccttcattgggatagaaaaacaaacataaaaacccaacagaataagtttgccaacctgagtacaggaagacccgtaggagtagttaaattttaactttaaagaaaatttgtctcacctaagaaagaacgaaggtcggtaggctcaatgagacttaagtaaaactagcgccaccgaggtcttgcttcctcctctctccttgtcccttccccatgcagccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttg

SEQ ID NO: 318034 - DNA, 844 bp, Homo sapiens
atgaggaggccgaaggtcccttccactgtgtccgcatggtgttcgaggacatcagcttttgatgtcagtttcctggggctgccataacaaaggaccatgtgcttagtggcttataaatgacagaaatatgttctctcacagttctggaggctagaagtccaaaatcaaggtgttggcaaggttggctccttcctgatgttctaggggagaatctgtcccaggcctctctcccagtttcttgtggctgccagcatccttggtgtcccttggcatgtagacgcatcaccccagtctctgcctgcaccttccatggtgctctcccctgtgtgtatctctgtctcctctccttgtaaggacaccaggcatacaggcatactggattaaggctcaccctaatcctgtgtgacctcatcttaatttgtctacatctgcaaagaccctatttccaaataaggtcaaattcacaagcactgggggccaggactttgatgtatgttttgggtgaacacaatttaacccataacactttcttcccttctcctgctttagacaacagcccggagacgcgggctaaagtgaagtttgtccaggacacttctaagtattggtacaagcctgagatctccagggagcagggtgagtgctgggctctgtggtgcatcagaggccatagctggctgaggcctgctgtgtcttccctgggcaaggaacagaggcaaattcagtcctctttgtagcagggggtcatcacagagggggctggggttgaagctggacagtaggaagcacttcctgcagtgaagtgtgggaacacagaagcagtagttgtagacacctcttggaa

SEQ ID NO: 318035 - DNA, 377 bp, Homo sapiens
cctcatccgcttcttcgtcaatatcttctaatccttcctcctcttcatcatcatcatcatttcttcccttctcctgctttagacaacagcccggagacgcgggctaaagtgaagtttgtccaggacacttctaagtattggtacaagcctgagatctccagggagcagggtgagtgctgggctctgtggtgcatcagaggccatagctggctgaggcctgctgtgtcttccctgggcaaggaacagaggcaaattcagtcctctttgtagcagggggtcatcacagagggggctggggttgaagctggacagtaggaagcacttcctgcagtgaagtgtgggaacacagaagcagtagttgtagacacctcttggaa

SEQ ID NO: 318036 - DNA, 10259 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318037 - DNA, 9826 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318038 - DNA, 10123 bp, Homo sapiens
  misc_feature (3601)..(3601): n is a, c, g, or t
  misc_feature (3712)..(3712): n is a, c, g, or t
ggagccacccagtagtgtctgagtggtgatccactcttgcctgcaatgaggaccaaggcaaaaagagttggctgaatctgcagcaggaaggatgagggttagataccaggaggaacttcctgacagtgagaaaagtaagacactctgtctgggaggctgtcgaatttcctttcatggtgccctttcagcaaaggaaggattgtgttttggagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318039 - DNA, 8048 bp, Homo sapiens
  misc_feature (1526)..(1526): n is a, c, g, or t
  misc_feature (1637)..(1637): n is a, c, g, or t
tgtggtgatctagaggatcccgacgctctctctgtggggacaggctctgggtagccccccttcactgatgttggtgaccccgttccagagaagagagtctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318040 - DNA, 5909 bp, Homo sapiens
gcggccgccacctgccaactcaaccgtcccatgccgccgctaatccgggacccacagccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318041 - DNA, 6116 bp, Homo sapiens
atgaggaggccgaaggtcccttccactgtgtccgcatggtgttcgaggacatcagcttttgatgtcagtttcctggggctgccataacaaaggaccatgtgcttagtggcttataaatgacagaaatatgttctctcacagttctggaggctagaagtccaaaatcaaggtgttggcaaggttggctccttcctgatgttctaggggagaatctgtcccaggcctctctcccagtttcttgtggctgccagcatccttggtgtcccttggcatgtagacgcatcaccccagtctctgcctgcaccttccatggtgctctcccctgtgtgtatctctgtctcctctccttgtaaggacaccaggcatacaggcatactggattaaggctcaccctaatcctgtgtgacctcatcttaatttgtctacatctgcaaagaccctatttccaaataaggtcaaattcacaagcactgggggccaggactttgatgtatgttttgggtgaacacaatttaacccataacactttcttcccttctcctgctttagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318042 - DNA, 9222 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318043 - DNA, 9339 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgcgtccccactcctgtacagctgctttgtttctttgcaatgcattgtatggctttataaatgataaagttaagaaaaaactcagaaacgaaatcta

SEQ ID NO: 318044 - DNA, 8088 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318045 - DNA, 8698 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318046 - DNA, 1385 bp, Homo sapiens
cagccgagacaaacaccaatcggctaggtacgaggctggtgggctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318047 - DNA, 609 bp, Homo sapiens
ttttttttttttaaaaaaaaattttccccggtacctcccttttttaggggattttgggcccttgagggccaaagtatttcggcccgtgggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318048 - DNA, 5278 bp, Homo sapiens
  misc_feature (3577)..(3577): n is a, c, g, or t
  misc_feature (3688)..(3688): n is a, c, g, or t
ggagccacccagtagtgtctgagtggtgatccactcttgcctgcaatgaggaccaaggcaaaaagagttggctgaatctgcagcaggaaggatgagggttagataccaggaggaacttcctgacagtgagaaaagtaagacactctgtctgggaggctgtcgaatttcctttcatggtgccctttcagcaaaggaaggattgtgttttggagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagtaagactcccctgcctgctcctcggtggggttctccttcctgtgactcatctattcatccgtgtacccacacatttaccacttgattgattccttgcacccaactgctcatcta

SEQ ID NO: 318049 - DNA, 3536 bp, Homo sapiens
ggagccacccagtagtgtctgagtggtgatccactcttgcctgcaatgaggaccaaggcaaaaagagttggctgaatctgcagcaggaaggatgagggttagataccaggaggaacttcctgacagtgagaaaagtaagacactctgtctgggaggctgtcgaatttcctttcatggtgccctttcagcaaaggaaggattgtgttttggagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggaggtgagttgggaagagggaagatggggaggggggccagggggaggaggactcctgtggttctggacagaaacccgggtctcagaatctggtcagcagccagctttgtgcccacactgaggtcaggcctgggttggggctctctgtgtaggggttgggggtgacagatttccttgcagccttcctgtctgttgacttgtggagtttgcacaactcccagcctcctctagcttgaggctttggaggcctggtctcagtttccttggtggtgttgag

SEQ ID NO: 318050 - DNA, 356 bp, Homo sapiens
ctccttccccttcctaccccgtcttcccccatttcttccttcctttctctctttctcccttcactgtctcctctgcccctcctgcctgccagtttctgctgtcttagctaacacccaccccacttttacaggatgtcggccatttctccgcatctaccaggccatgcaacctgtgtacacatctggcatctagtaagtattacatgggcgtgagaggccagagaagcccaaggcccagggctaaggaccaggtcagaaggttggggagaggagagaatattctcaagagggctgaaaggacagagtcagagaggtttcccactaaccctgtggcgtaggggcagcagggagaaaat

SEQ ID NO: 318051 - DNA, 290 bp, Homo sapiens
tctttccagctctagggttttaattcctactgaatttttgtcttagaccccacagatgaatcgaaagatagctccggccctgccaactcaactgcagacctgctgaaacaaggggcaggtgagtggtcacctgaaactgtacccatgcccaggcctctctttctgccttcctgccctgacccctcctgcacgtgcaggctggaggtctctccaggcccaaatgtctctgggaagatcacatttctatgtgcagatgccttggctcaaggctagcctgaaatttatctgct

SEQ ID NO: 318052 - DNA, 420 bp, Homo sapiens
tgggaatcttctctgttggatcttgttcaacaagagggtgtgaattttcagctttggtggtgggttgaggtagaggtaataaagaagtggaagattgtgtgtatcggtgtaagggtagaggtggaggtttcccttctggcttccagtatcactgcccatgacatgccgtctgcctccctacaggatcgctgtctgccctggtctaccagcactccatcatcccattggccctgccttgcaagctggtcattccaaaccgaggtaggaacgtgagactcctggctcaccacccacacccttgagctggcccttgtcatgtcttgatcctgccagccactccggacatgggccagggctggaggacacatgtcattttgccagtctggagaaactcaaaactactctccttttcttcctatt

SEQ ID NO: 318053 - DNA, 350 bp, Homo sapiens
tcctgatttacccctatgacccggcatgagccttttcaagaatgtgagaaactagactcccagttctcagtccagcttaagccactggtcccgcccaccacgctcaagaaaatgagaagtccctcagggagcctcttttggggagcttgtgggctttctctgtttttccagctgctgatctcttttccctctctgcactgtctccccgactgccgctgcctttcccatcccacttaggcatggagcacctggagaacgggccgagcgtgtctgtggactataacacctctgaccccctcatccgctgggactcctacgacaacttcagtgggcatcgagatgacggcatg

SEQ ID NO: 318054 - DNA, 396 bp, Homo sapiens
caaaaatgctcattgtcctctacaccctgctttcctcccaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagaggtgagtccttaagctgtatcttggggctatggagggtagtggtgcccactttaaatctccagaaacctgatggtcaacttggcactgatatcagtatactcagtgatttgtctccccctacgtcctcacccaaactctcttctctgacatgtggagtc

SEQ ID NO: 318055 - DNA, 1613 bp, Homo sapiens
gtctcgccctcttgcagtctgcagcttctcctgtcatcggaaatgccaggccaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318056 - DNA, 642 bp, Homo sapiens
tgtactcacagggatgggatagctgtgcctaggtgggggtgtaccaggcgcaagttttcagatgccagcctgcagtggtgtgagctcaggcacacaggagagcccgggagccagcctgtggtgtgtgcccgcagattggcacagcacttgactctgaggcctgtgctagagagcagtgcaaccttcatggggaagcatgagtctggggataagaaggcgctggtctaggaaggcatgtgctgttcttggccctggaagcaggattgcttcagtgcttggatgagtctacgggagactgcatcactgccccctgctgtgggaggtcagacactcatgataagggtcaccttctgttgggagagtttagacagttttactgagagctttcaaccacatggtctcattggagtctcacaatagcccaggcaggaaacagggcagggatggatttattcattcagcaaaatttaaatcatctactatggctccaagcactgagatatctgggtgaacaggaaaaagtcctttcccttggtgagctgatacctaatgagagagatggacatgaaacaaataaccatacaaacaagacagtgtcagacagcaatgaggctaggaaggaaagagggcactgcagacacg

SEQ ID NO: 318057 - DNA, 10099 bp, Homo sapiens
  misc_feature (3577)..(3577): n is a, c, g, or t
  misc_feature (3688)..(3688): n is a, c, g, or t
ggagccacccagtagtgtctgagtggtgatccactcttgcctgcaatgaggaccaaggcaaaaagagttggctgaatctgcagcaggaaggatgagggttagataccaggaggaacttcctgacagtgagaaaagtaagacactctgtctgggaggctgtcgaatttcctttcatggtgccctttcagcaaaggaaggattgtgttttggagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318058 - DNA, 10026 bp, Homo sapiens
  misc_feature (3504)..(3504): n is a, c, g, or t
  misc_feature (3615)..(3615): n is a, c, g, or t
gtctcgccctcttgcagtctgcagcttctcctgtcatcggaaatgccaggccaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318059 - DNA, 7681 bp, Homo sapiens
  misc_feature (1159)..(1159): n is a, c, g, or t
  misc_feature (1270)..(1270): n is a, c, g, or t
accatttgcaagatgatgcaatttagccctttccaagagttcttccccacaggcttgatgttgctggttggttgatgcagttgccttggagactgtcttttccctccacctcccctcccttgtctggaagctctggccctccgcctccaggggttggaagtagttgacatctgtttcttgtatcagtcctttgtgttcttggtctcagctctgtgtggagagattcctggtgaagtctgagccaatctaagcagatcccctctcctgcagagaaaacctggggtgtgaacagagttggacccaggagggctgaggggaagacaatgggggatgacaggcgagccccagcatggcctctgagctaggaggcactgccttctctgatgggattaggccgattgatcatttcttacacaaaaatgctcattgtcctctacaccctgctttcctcccaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318060 - DNA, 6289 bp, Homo sapiens
tctgtctgcctgatgtgggaggtttttgcattttacagggagagagaacaaagttgggaataggggaatgattctcaggggaaggctgggtgtgggacaggggtcagcaacggcagcccatgggtcaaatctggatgctgcctgcttttgtaaatgaagttttactggggcgcccccacacctgctggcttgcatcctccctgtgctgctgtcctgctgcagtggcagagtggagtagttgtagcagaggctgcatggcctgcgaagcctgaaatatttactctccggccatttacagagtaagtttgccagccaggtgtggtggtgcacacctataatcccagcacttcaggaggccaaggcagggggatcacttggggccaggagttcgagaccagccagggcaacatagtgagatcctgaatctacaaaaaacaaaaagaaaatgagccaggcaaaatggcacacactgaatagtggcctgtggtcccagctactggagaggctgaggtgggaggatcacttgagcccaggaggttgaggctgcagtgagccatgattgtgccactgcatgccagcctgagtgacagagtgaggcccggtctcacaaaaacaaacataaaaacccaacagaataagtttgccaacctgagtacaggaagacccgtaggagtagttaaattttaactttaaagaaaatttgtctcacctaagaaagaacgaaggtcggtaggctcaatgagacttaagtaaaactagcgccaccgaggtcttgcttcctcctctctccttgtcccttccccatgcagccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcccctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318061 - DNA, 7247 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggtta

SEQ ID NO: 318062 - DNA, 8791 bp, Homo sapiens
  misc_feature (3737)..(3737): n is a, c, g, or t
  misc_feature (3848)..(3848): n is a, c, g, or t
  misc_feature (8759)..(8759): n is a, c, g, or t
  misc_feature (8771)..(8771): n is a, c, g, or t
  misc_feature (8778)..(8778): n is a, c, g, or t
  misc_feature (8781)..(8781): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagagcggggtgccatgtggcgttgggccccaagtcagccatagaaggagttttgttcncctcccaagtgncggttgnttncccaaataat

SEQ ID NO: 318063 - DNA, 6237 bp, Homo sapiens
  misc_feature (3737)..(3737): n is a, c, g, or t
  misc_feature (3848)..(3848): n is a, c, g, or t
ctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggaggctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctctgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccntctgcccagagaaactaccagagctcttctcctctcccgactgtgggcagtagctacagcagccccgactactcacttcagcatttcagctcctctccggaaagccaggcncgagctcagttcagtgtggctggcgtccacacggtgcctgggagccctcaggcgcgccacagaacagtgggcaccaacactccccctagtcctggcttcggccggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcatcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaagagagagagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtagggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttg

SEQ ID NO: 318064 - DNA, 586 bp, Homo sapiens
cgcggacgcaagacccgctggggtgcgtctcctcttggccgtggagggcagcaggctggccggtgctcacttggctgggccaggagcaaccctccactcccagcctatcctctgggtgtgcatgtgtgtgtgtctgtggttgtgtttctgtgtgtatgtgtctatggatgtgtgtttcagtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaagaaaaaactcagaaacgaaatcta

SEQ ID NO: 318065 - DNA, 552 bp, Homo sapiens
ccctgcacagttggagagatgctgaaacactcttttcctgaaagcttctcggcacaggatggcagggggaagaggcttgtcttccctccaggacaaaggtgctctttggccagagtgctctgcaggtctgagggagcaggggtggggaaaacaagcggctcttggatgcaggagttgcctcttttgaccacctgtctctccctgcagtgcggaccaggctctggaccggtttgcaatgaagcggttctatgaggataagattgtgcccattggccagccatcccaaagaaggtgggtctctggggctcacagccccttgcatgtatgtgtgcactcactctatgtggggactagacttgtgtactcacagggatgggatagctgtgcctaggtgggggtgtaccaggcgcaagttttcagatgccagcctgcagtggtgtgagctcaggcacacaggagagcccgggagccagcctgtggtgtgtgcccgcagattggcacagcacttgactctgaggcctgtgctagagagcagtgcaaccttcatgggga

SEQ ID NO: 318066 - DNA, 441 bp, Homo sapiens
cttctgcacctctctgagtccctgatgctgaggcctgctggagggatggggaagagaggttggcctgagaccagcttgctcacctgggctgctgtccacctcctggggttccacttgcccttccctcatgcccgttgccctctcccgcctgcaggctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagaggg

SEQ ID NO: 318067 - DNA, 5530 bp, Homo sapiens
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaaaaaaagtcgacg

SEQ ID NO: 318068 - DNA, 4414 bp, Homo sapiens
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttatta

SEQ ID NO: 318069 - DNA, 5427 bp, Homo sapiens
tatatttaatggatcagctacatttccagtgctaaggagttgcacgaaactgttggtttctgtataagagaccatgggggtaagaggcttgatccaactcggggtagatgtttttgacagtaactcctggaggatagtatgtgactgaaccactggaattgctcaagtctaaacctgcttttctttttttttcaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaaaaaaagtcgacg

SEQ ID NO: 318070 - DNA, 3491 bp, Homo sapiens
  misc_feature (16)..(16): n is a, c, g, or t
tctgaggatcccttanaggcgatcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaaaaaaagtcgacg

SEQ ID NO: 318071 - DNA, 4606 bp, Homo sapiens
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaaaaaaagtcgacg

SEQ ID NO: 318072 - DNA, 4680 bp, Homo sapiens
  misc_feature (4619)..(4619): n is a, c, g, or t
  misc_feature (4621)..(4621): n is a, c, g, or t
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccaccttaaccngnaagcgcctgggtggaggcagggtagggcaggggcctggagaccactcctctgaaccagg

SEQ ID NO: 318073 - DNA, 450 bp, Homo sapiens
cgaggctgttcccacagtggttggcattcctgatggcacggctgtcgtcgggcgctcatttcgagtgaccattccaacagatttgattgcctccagtggagatatcatcaaggtgagactggatataaagcataaatgaggaagagttctcattttccattttagttttggtggcttttccttttcaagtctaagcttcaccaattctgagctcagttcttccagtacccccttagaagagggacagccactgatgttcataagagaatccctatatactcagaatagcatcctaaactgtattcttgttcctattctgagggcatcaccatgtaatagcctttactctggaagttctactgaacactgatttagggatttgttggaaaggtctgtcacgtgtatagggaaaggttacctttaataaaacacagagttaaaccccaaaaa

SEQ ID NO: 318074 - DNA, 585 bp, Homo sapiens
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggccactgctctccaggaagataaggcttttaaagcagcctagcactagaagagatggggttcttcctctttgcctaggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttgggattctcattctgcactccagcctgggtgatcaagtgaaactgtct

SEQ ID NO: 318075 - DNA, 4023 bp, Homo sapiens
  misc_feature (13)..(13): n is a, c, g, or t
  misc_feature (22)..(22): n is a, c, g, or t
cctgggtctagcnagctccatncacagcctacagtgcctcaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaaaaaaagtcgacg

SEQ ID NO: 318076 - DNA, 5425 bp, Homo sapiens
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaactcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggccgttggactctgtgagatggtatagcctggggataatctcaggcgacctgcagcatcaggg

SEQ ID NO: 318077 - DNA, 2582 bp, Homo sapiens
cgccgcccctcctcctcgccgcgcagagccgcgctgcgccgcgcgctcccgccgcccctccccacgcgagctccacccaggtcgcaggcagcgcggtcggcggcggctatttcccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgata

SEQ ID NO: 318078 - DNA, 1945 bp, Homo sapiens
gtcacacatggacagcctcatctattttattgacccatttccagatgctgggattaccgagttacattaatacacagctttttatggtatacagtaatgtaatatattagcctaatgtgttaggactccttaaacaagggatactgtaatcattaatacagttgatccattaggcttggcacagtgtttattttatggaaacactctaaaagaaaaacagacctgaagttcatcatgtgtaaggttacacaaatctatctttcaaatgagttcattactctaaataattgtcagaagttacatttttgtttaatataatctttgcagtaaccttccaaattagggcaatttttctgtccagatctgcctactgaactagaatatttaatgagcaacaacttctgttgtgaattaacggactgatattggggtttgataaatcagtttcctaaggtttggataagccaagagttagactctaagaatataaaaaggcctagataacatcataaaagtaaggttctagatccacaaagcagagaactagacccagattataagtcactccagaggtcccatttttctggatttgagggaggaagtgtttgatgacagtatttgaagtgattttatatccattttcttttaaaaagtaatagtttggaattagttacttgttaattaatctgtaaaatatttgctgtggtgttataatgtgaaaatgtggttgctaattttaaaataaattttgggttttttaaagtaaatttttaaaaacactttttatgtatatcacagcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtgtaagtgtaagtgttacagcctagtcaactatcgactgttagcctcagtgtgtccagagctgcctgtaacgtgctcatagtggaattgagagtcaggtcttcattcctcacaataagtgttttcagtaatctctctctcgttgccccatttttctcttacattaattctcttcactgaaatgaggacaaaagagtatacaaggctgggtgcagtggctcacgcctgtaatcttagcactttaggaggccaaggtgggtggatcacctgaggtcaggagttcgagactagcctggccaatatagtgaaaccctggctctactaaaaatacaaaattagccaggtgtggtggcgtgtgcctgtaatcccagctactcgggaggctgaggcaggagaactggaggcagaggttgcggtgagctgagatggcaccattgcactccaggctaggcaaaaagagcaaaacttggtctc

SEQ ID NO: 318079 - DNA, 790 bp, Homo sapiens
ctgagaaataatagatcaaatggtttgcactaacctcagttgcggaatatattataaaatcacaagaaagcagattgtttaccagtgctcaaatgaagacaattaagaatacactgctggcgatcagctcaagaggtaaaggtagaagaaaaaatgaggtagactgggcatgtttaaggcaaaggggaatataaaatctgtaaaattcactaggctgatctatgtatgacggtagttttagtgtttccttggtttagccctgtaaatacaccacttagaaataatcatacttgggaactattttatgtctaggtgcataccagatgctaggtattagatttgcgggggtatcgcctgcccccagaaagttctaccttgaccaagactgttgtaagcctacacacttagtgacgtttagcttagtaaactggacagcgcctcataccctttattaaaagtggtagaaacttcatggctcatcatcggtgtcagcaaaactgatgtgtttagatgattaaagtcaaatgactgaaagtgttttcctgcctttgtaggtgttcataatgtgacagccctgagcaacctcataacgtggcagaaggtggattatgacttcagctaccatcagatggaattcccctgcaatattaacgttttcattacttcggaggggaggtcactcctcccggtatgatgagtcatttttaaatggagggaggttgacattggaaaaatacctacatttttgctgtttcttggtaccgcttattaataagttacatttgttgta

SEQ ID NO: 318080 - DNA, 777 bp, Homo sapiens
tttcggcccctcacttttgcttgatcttgttgaagtgacagatagactgtctctggggcctcccagatggttcagtggaacttctggtgtcttcctggtccccaagactcattcgccattgcgtcatgggtccctccttgagaggctgtaagtgtacatacacgtatagtttgtcccccgggcccacgttatggagaaggaattgcacgacgcctgccggccgcactgtcaaacgccaccatcgtgggctcggacaccgcctccgtccggcctcagcgccacggcccctaggagcagcgcggcccacaagctcgcgccgacctcgttccaccctccgcctgggcgccgccatgttggactagggtcctccctcgtccgaattcggcacgaggcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataattcgatacaagtgttctgtgaaggtactattccgtgggcaaccactcaagttaactgtaaattttcctagtggaac

SEQ ID NO: 318081 - DNA, 3990 bp, Homo sapiens
cgccgcccctcctcctcgccgcgcagagccgcgctgcgccgcgcgctcccgccgcccctccccacgcgagctccacccaggtcgcaggcagcgcggtcggcggcggctatttcccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagta

SEQ ID NO: 318082 - DNA, 2858 bp, Homo sapiens
cccttgggtttaccccgccccccccgagtatgggatatcgtcaccacggtccgatctgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagta

SEQ ID NO: 318083 - DNA, 2753 bp, Homo sapiens
ctgagaaataatagatcaaatggtttgcactaacctcagttgcggaatatattataaaatcacaagaaagcagattgtttaccagtgctcaaatgaagacaattaagaatacactgctggcgatcagctcaagaggtaaaggtagaagaaaaaatgaggtagactgggcatgtttaaggcaaaggggaatataaaatctgtaaaattcactaggctgatctatgtatgacggtagttttagtgtttccttggtttagccctgtaaatacaccacttagaaataatcatacttgggaactattttatgtctaggtgcataccagatgctaggtattagatttgcgggggtatcgcctgcccccagaaagttctaccttgaccaagactgttgtaagcctacacacttagtgacgtttagcttagtaaactggacagcgcctcataccctttattaaaagtggtagaaacttcatggctcatcatcggtgtcagcaaaactgatgtgtttagatgattaaagtcaaatgactgaaagtgttttcctgcctttgtaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagta

SEQ ID NO: 318084 - DNA, 2125 bp, Homo sapiens
cgagctgtatacttcaatatgttgtatctcagggaatggagaagcaaggagcgtgagagagcgataggggtatggctagttggtggagcactcagaacacacacacacttatcaattcaggtttgttgtctcatatgggcattgttagtggtgtcccgaaacaattacaatagtaacatcaaagatcactgatcacagctcaccatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagta

SEQ ID NO: 318085 - DNA, 1979 bp, Homo sapiens
cgccgcccctcctcctcgccgcgcagagccgcgctgcgccgcgcgctcccgccgcccctccccacgcgagctccacccaggtcgcaggcagcgcggtcggcggcggctatttcccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccgcagactgccagattcacttacagccccaaccttgcatgcctggggtaccgagct

SEQ ID NO: 318086 - DNA, 330 bp, Homo sapiens
aggctgacatgcaccttactacatcagtcaaggaaccatgttaattttcttttccttacaaaaatgcacatcatttacatttactcttttgataaaggcagttgaagatgactttgtggaaatgcggaagaacgaccctcagagcatcactgctgatgatcttcaccagctgctcgtggtggctcggtaagtggcgcacgtccattattgctgtttcggtaagcttgtgtatatgtcttctgagttattcagcagtaactgaggcagaattctaaaaacggaaatgaacttttccttttaaaaacgctgttgacaaaggctcattgaggg

SEQ ID NO: 318087 - DNA, 4375 bp, Homo sapiens
cgccgcccctcctcctcgccgcgcagagccgcgctgcgccgcgcgctcccgccgcccctccccacgcgagctccacccaggtcgcaggcagcgcggtcggcggcggctatttcccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagtaccttgggctgtttttcatgagtaagaagattcaccatcccatgtgatctgtgtggaaaaagaccatgtcctcttggtggaagacatgagagagctgaactgaagtggaggaggtggtgcaagagggaccttcctgctcaaggcccgcccaggcagcggaatggagtgcagtgcttggctgcagaaaccctttgtccctcacctatatatacacggacagtcaagtttgttgctctaacgtaaggcacagcgttaatcctgtatggccaggaaactgagtagactcctgtgtaaccctgtttggaactttgccttcttaaaatgatttttcaaagatctctttcgaactaatttctgtagagtttaaacgtgtattttatcaccta

SEQ ID NO: 318088 - DNA, 466 bp, Homo sapiens
  misc_feature (20)..(20): n is a, c, g, or t
  misc_feature (32)..(32): n is a, c, g, or t
  misc_feature (36)..(37): n is a, c, g, or t
  misc_feature (59)..(59): n is a, c, g, or t
gcgtctagaggatcccttanacgtatcagaanactnntatcgaattacaacatctgttncagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggtatgatgagtcatttttaaatggagggaggttgacattggaaaaatacctacatttttgctgtttcttggtaccgcttattaataagttacatttgttgta

SEQ ID NO: 318089 - DNA, 4084 bp, Homo sapiens
gtcacacatggacagcctcatctattttattgacccatttccagatgctgggattaccgagttacattaatacacagctttttatggtatacagtaatgtaatatattagcctaatgtgttaggactccttaaacaagggatactgtaatcattaatacagttgatccattaggcttggcacagtgtttattttatggaaacactctaaaagaaaaacagacctgaagttcatcatgtgtaaggttacacaaatctatctttcaaatgagttcattactctaaataattgtcagaagttacatttttgtttaatataatctttgcagtaaccttccaaattagggcaatttttctgtccagatctgcctactgaactagaatatttaatgagcaacaacttctgttgtgaattaacggactgatattggggtttgataaatcagtttcctaaggtttggataagccaagagttagactctaagaatataaaaaggcctagataacatcataaaagtaaggttctagatccacaaagcagagaactagacccagattataagtcactccagaggtcccatttttctggatttgagggaggaagtgtttgatgacagtatttgaagtgattttatatccattttcttttaaaaagtaatagtttggaattagttacttgttaattaatctgtaaaatatttgctgtggtgttataatgtgaaaatgtggttgctaattttaaaataaattttgggttttttaaagtaaatttttaaaaacactttttatgtatatcacagcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagta

SEQ ID NO: 318090 - DNA, 3825 bp, Homo sapiens
cgccgcccctcctcctcgccgcgcagagccgcgctgcgccgcgcgctcccgccgcccctccccacgcgagctccacccaggtcgcaggcagcgcggtcggcggcggctatttcccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgcggatcgcctccgcccggtcttcgccggccccggcccctggcgagatgccgtgtggggaggattggctcagccacccgctgggaatcgtgcagggattcttcgcccaaaatggagttaatcctgactgggagaagaaagtaattgagtattttaaggaaaagctgaaggaaaataatgctcctaagtgggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgttcttcattttggaaaatatagagatgtagcagagtgtgggcctcaacaagaacttgatttaaactctccacgaaataccactttggaaagacagactttctattgtgttccggtgcctggggaatctacgtgggtaaaagaagcctatgttaatgcaaaccaagctcgagtcagtccctcaacatcctacactcctagtcgccacaagaggagttatgaagatgatgacgatatggacctacagcccaataagcagaaagaccaacatgcaggtgccagacaagcagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtttatgaagattgggattgtttcaaagtaaatgacattcttgagctatatggcatactgtctgtggatcctgtgctgagtatactgaataatgatgaaagggatgcctctgcactgctggatccgatggagtgcacagacacagcagaggagcagagagtacacagtcctcctgcttcattagtgccgagaattcatgtgatcttagcccagaagttgcaacacatcaacccattattgcctgcctgccttaacaaagaggagagcaaaacctgtaagtttgtttcaagtttcatgtccgaattgtctccagtcagagcagaacttcttgggttccttactcatgcccttctgggggatagtttggctgctgaataccttatattacatctcatctccacagtatatacaagaagagatgtccttccactaggaaaatttacagttaacttgagtggttgcccacggaatagtaccttcacagaacacttgtatcgaattattcaacatcttgttccagcatcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtgttcataatgtgacagccctgagcaacctcataacgtggcagaaggtggattatgacttcagctaccatcagatggaattcccctgcaatattaacgttttcattacttcggaggggaggtcactcctcccggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagta

SEQ ID NO: 318091 - DNA, 2137 bp, Homo sapiens
tttttaagagtcaacaacacaccctttaagccaagaaaaaaaatacatcaggaggggaggtcactcctcccggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggcagttgaagatgactttgtggaaatgcggaagaacgaccctcagagcatcactgctgatgatcttcaccagctgctcgtggtggctcggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgtaaaattcagatattcatttataccacattgttttataggtaatttctatcacaaaccagtgacatttcctgaaatcaagcctggtaacacctgatgtttatatgatattcagtaaggacttttaccttactgatttcatggagcttttgaagtttgttttataataattatataaattagtaatgatgtaaaaaaagtatttgatattaaaagtttaatattgataatgttgctgattgtaccatttccttagcttcagctgagtcataggccagactgttgaaatgctgaaatgaagaaggttgttgcagtttcaaagtcagaggaatcgtgcttcggatttcttatgttttctagttctctgtttttccagttcacagtgggttggggtgcattcagtagtccatctttggggaacggaggcgtacttgccattgattcacatgactacatgaaattctgtactgtcatttcccagatgtttggccacagaaactttttcccacttaacatttgttaacagcctgcaaaactaaacttgtacatggcagtggttcccagacttttgtattttatggaccggtagtaatatttccaaaaatctggggtactataaggttgccaatttaccttgccaagtaatccgaataaatcactgtattatcaccatttttttcataaaaggaaaggacaatctatctctgaataagaggagtcctttaaacggaatgaatgtggcttttgggggcaaaagaaaccaagacactacattgtctttattttctcctatcccagtgcatttgagaaccatgcataagggaatgctgtgctacaaagctgtgcccaaatatgaaaacaaaataggaaacttaaaaagcaataccccctttagaaagtttttattttcttaaatgtcattgagttgctttgattctattggatttttggcattttttatgggatcatcagttggttccaagtatgttagatcagctaacatctgctactccagtaacagcctcgtacaactgcaggtaggttttctccagaccaattagttttaatagagcaaactaacaacagactgtagtagcatggttatggcaaccagaatcttcagaaaggttaggacattactttttaagctgtcagtggtatcaaataacttacctagttggaggcagataaaggatcccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttttataaacaaatgtaaataatgtttatattagagttgaactggttttcatttttataactggtagactagaccttccttaaacttttagaaataaaatgaaggcttcactggatttgtgaggataaaatacattttctttaattgtcctagagcaaagtacattagtcaccatgtgttttttgtgccaatgtaacttgtaatttaccaaagaaaaatacatacattgcttggtcttgcagaaaagttcccttgaaagaacctttccaataaataaaacgtcccaaattagcagta

SEQ ID NO: 318092 - DNA, 625 bp, Homo sapiens
ctcaaaaaaaaaaaaaaggaggatgcaaactgccttatttttaagattagcatcacttactgacggatatgttaagctttacctactgtcgactgaattgtgctttgctcacgtagttatttttttacctaagacacttgagaggaactggagtgtgtgtcctgactcaggtcttcctttctccttcagaagtttgtttcaagtttcatgtccgaattgtctccagtcagagcagaacttcttgggttccttactcatgcccttctgggggatagtttggctgctgaataccttatattacatctcatctccacagtgtaagtgctgtatcctggtgggaattaggggagtttggtgtgtgtggaagtggaagagcgggaagattgctggtgtcatttgtgtgttttccttattgggcttcatcacatggtttttatctgtccagtgttaactgttataccaaatcacagacaaattccttttctcacagttcacatttagcattttgattatgtccccttaaattttagagccaaaatcagataaagcagtggtccccaaccttttaggcaccaaggacccatttcatggaagaccatttttccatggaccggagtggggatgg

SEQ ID NO: 318093 - DNA, 4332 bp, Homo sapiens
ctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 318094 - DNA, 4176 bp, Homo sapiens
ctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 318095 - DNA, 2425 bp, Homo sapiens
tccctgaccttgcctgcttgtgtcctctccctccacctgtcccctgtactggggacctgttctcaggagatcacagttcattgctcaaagccggggctggggcctcctacaggaccatcagtttctcctgatcagcagcctttccttccgcagagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 318096 - DNA, 3988 bp, Homo sapiens
ctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttgcttggaggggttcttaaattatatttaaaaaagtaactttttgtataaataaaagaaaatgggacgtgtcccagctccaggggt

SEQ ID NO: 318097 - DNA, 348 bp, Homo sapiens
ccgagatgagctacgtccaccgagacctggctgctcgcaacatcctagtcaacagcaacctcgtctgcaaagtgtctgactttggcctttcccgattcctggaggagaactcttccgatcccacctacacgagctccctggtaatgctgggggtaatactgggtgtgagcttcttagggccaggtgggcagggcaggttggaaaggtgggaggctgagggtttggcagccctgctccagggagaggatacaggagcaggctgtgggtggggggacagtcagctccaggaagccgacttccagatgtctaggaaaataacagttggataacctgggcaacatagcaaga

SEQ ID NO: 318098 - DNA, 759 bp, Homo sapiens
aagcctgtaatcccagcactttgggaggccaaggtgggcagatcacctaaggttaggagttcaagaccagcctggccaacatggtgaaaccccgtctctaaaaaaatacaaaaaattagcccagcatgatgggcgggtgcctgtaatcccagctactcaggaggctgagacaggataatcgcttgaacccaggaacagaggttgcagtgagctgagatcacgccattgctttccagcctgggcaactgagcgagactctgtcttaataaataaataaaagagttgggtacagcatatttgggtcgcagaaggatgcagagatggagggcagggttgagaggtaacatgtctgtatcatagcccaagagctgctggggccttcagccacagagagcttcaactccggctaggaggattcctggatctgttattttttggggggctgtggctcctatcctaccatcttccaagtcaccatttcctgggcctgttagcatctttgcttttcctggacagcctcacccagagcttcttcccctctttccaggtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcgggtgaggatgcaggaatgg

SEQ ID NO: 318099 - DNA, 3222 bp, Homo sapiens
tggagatgggatctcgatatgttgcccaggctggtcttgaaccccttggctcaagcgatcctccagcctcagcctcccaaagtgctgggattcgaggcatgagccaccgagcccaccgtgcagatggatgtttttgtgcatgcttttgatgaatgctttctctctctcagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 318100 - DNA, 4271 bp, Homo sapiens
ctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgattcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 318101 - DNA, 3168 bp, Homo sapiens
ctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcgggtgaggatgcaggaatgg

SEQ ID NO: 318102 - DNA, 1277 bp, Homo sapiens
ccacagtacagggagaaggaacccaggtggggtcccaagccagttagagtatttaaggtagagtattggagagtgcttcagagtattggagtatttttgaaaattcaaaaatatacagcacccaacaaagtaaaattcacaatgttgggcatctactcaaagattaccagacaagcaaagaagcaaaataagatgaaaatcagtaaaaccaacccacactgacagatgccagaattagcagacaaaaacattaaaacagttataactgtttaagatgcttaacaagttgagatatggaaggtataaaaaaggcccaagtcaaacttctagagatgaaaaccacagtgtctgatggaattaacaaaggatgaaattagcagatgattaaatactgagtgagctttggatggaattaacaaaggaattaacaaaggatgttaattaacatgtgtctgatggaattatcaaaggatgaaattagcagatgattaaatattgcaaaaaacgtatatttgaatttgagggcatagaggtggaaaatattcaaaatgaaacatggaaagaaaaagtaattttttataagtgaagagtatcattaagctgtaggacaatttcaagtggcctaatatggatataattggtgtccttgaagggacaacagaagaaaaagggacaaaaatgagaaaaaaaaaaaagagagagaatgaagagacaaagagaaaaaagggaaacgaaagagaaaagggagacaaactgaaaaggggagatggctgaaaattgtccatacttgatgataactattaatatgggcccacagatccaaagtgctcaacaaaccctgagcacaaaaaacaacaacaacaaaaacaaaaaaaacgaaaaaaaactacactaagacacatgaatcaaattgcttatttgattagaacatcttagaagcattcagaacaggactcatgatatacaaaagaacaaagacaaggaatatttattgttagaaataagtgagaagacagtggaaaatctttaaagtactgaaaaaaaattgtcaacctaaaattctattcctagagaaaatctctttcaaaaacaaaggcaaaatagagtttttcagacttacaaacactgaaagaacaagtcaccagcagacctatcctacaagaaatgtttaagaaagtccaacattatgctcaaagaaaatgctcattggagcattttgtattttctgttttctgattagggatgtttaaccagtatatattctgcaagtactaaaa

SEQ ID NO: 318103 - DNA, 139 bp, Homo sapiens
cattttagatagggatattcagcctgtacttatagggaaatttatagcactaaacagaagctctcaaaatcagtatcctcagcttccacctaagaagctagaaaaagatgagcaaatataatgcaaagtaagcagagaa

SEQ ID NO: 318104 - DNA, 422 bp, Homo sapiens
acctaaaattctattcctagagaaaatctctttcaaaaacaaaggcaaaatagagtttttcagacttacaaacactgaaagaacaagtcaccagcagacctatcctacaagaaatgtttaagaaagtccaacattatgctcaaagaaaatgctcattggagcattttgtattttctgttttctgattagggatgtttaaccagtatatattctgcaagtactaaaaaatctgaaatctgaaatatgtctggtcccaagcattttagatagggatattcagcctgtacttatagggaaatttatagcactaaacagaagctctcaaaatcagtatcctcagcttccacctaagaagctagaaaaagatgagcaaatataatgcaaagtaagcagagaaaggaaataaagatcagaataaaaat

SEQ ID NO: 318105 - DNA, 90 bp, Homo sapiens
tggacttcacagctgttaaaatgttgatgtactgtttacagtgtgaatctccaacaaggcaggagattccacattcccttcttagggcaa

SEQ ID NO: 318106 - DNA, 324 bp, Homo sapiens
ctgcttcctgtcactgccaacagagtatggatgtggtcagtaaggtgtggatagtacaggtcaccctgatttccttccttgatctgtgcagaaatgcatgctgtactttctccacttaaagatgagtggatagggacagagaatgacaaaaaaaccaaaacagatcaaaaaccccaccatactggacaagtgtctgagagtatacaaatattctaaaagaggcattttgaatttaaattttcttcacaattaatgcaactctgcaaaagttaaagaggaatagcctgaggagaaaaaatatggtcataatataacccccagcct

SEQ ID NO: 318107 - DNA, 3925 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgaattactaatttcagctggattcaatttgttgtcagttgattctgtagtaaggccatatgttgcccctctggaggtgcttgtcaactactctggatgatggatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318108 - DNA, 3935 bp, Homo sapiens
cggctggtacagcctcggagttacgggatcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgaattactaatttcagctggattcaatttgttgtcagttgattctgtagtaaggccatatgttgcccctctggaggtgcttgtcaactactctggatgatggatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318109 - DNA, 3844 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318110 - DNA, 3824 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318111 - DNA, 3180 bp, Homo sapiens
ggaggcctgcgcacggattcagtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318112 - DNA, 3923 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagaggtgagattgagacatttactcagttagatcccaatctcttcactccttgccctgctacatataagtgtccatgtttcagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318113 - DNA, 4116 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaaggttagtgtgttcctgttactaagtggctgccgttcctcaaatgctgtcattgagctggtaggcattactgtgagatctaaaccttctcaagagaagaggggacaatgagtattttctgtatgcttgttattagttctttccccaggggtgttaaatcagtgaacacgacagctaagataaacatctagggagcttggctcttaggtctgcatttgccacattgctttcggaaagcaggagatatcctttctgttgacttagagtttgctgcaggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318114 - DNA, 3175 bp, Homo sapiens
agtcttttcaactgccttgaagactagccattttctggggttctaaggggtgagagaggaaatctggcttactgctgtttgatggagtcacggtctaggttaattttagttcaagggatgcctttggggaatttggctggacttgaagcagaagaaaacagttcatggatttagacttctgcctgctgagtctttgggttctttccagagctggagctcagaactgaggctgaggtcctagtgcagtgcctcatgaaccagggctgctaatggcctgcatttgatttctaagtgaatagatgacaatttctgctgagggtttattggtagatcctgacagtctagctttttcctgtctttcctatttctagctgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318115 - DNA, 2757 bp, Homo sapiens
  misc_feature (61)..(61): n is a, c, g, or t
ttatgcacagaactgtaacagatgggacatttactccacgtcttctcactcagtgaaaganagcaggatcatgcccagcagaagatgtgtccacaacgggttatcttggctgcagtaggtggatagaggcatattgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318116 - DNA, 4090 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgaattactaatttcagctggattcaatttgttgtcagttgattctgtagtaaggccatatgttgcccctctggaggtgcttgtcaactactctggatgatggatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacaaaaaaaaaaaaaaaaaattcgggggcttatcttatatgtcgggtgtggcggggagaaaaagggtgtatatggaatttgggcactatgggtctataagctggtttcctggacccaagtttttttggtacaaggtgggtgagatcttggccgggtctccctatataggtggagtcggtatttaaatttcggataaagccaaggttaacctggtttaattgattgggggaaaaagaaaaaacgacttacaaaggacgggtgacaagtcccaataggctcaacacgaacggaccctagtaggacaaccccacatacaaccgcgtacaagaaaaaccatgcaatgatgccaagaccaacaagcaacccgacgacaccaagaagcgaacggtaagaaggcaagacacccgacaaacacaactcattttcaccgagagatatacacgcatcagagaacgaagcgaaccgaatacgccacaaactagcggacacacaaagaagaaaccgacgaatgcacaccacaccctaaaaaactatagaaggcaacgaccaaacaatgccacagcgtgagtatcaatcacagcaaacgagaacactacagagggaacaacgcagacataaaccggggaaagaaacgaagaaataacgacaaagagccaacgacgcgcagacgggagaaactaaccaaaccgcaagaccacaaacttaaccaatccacaccaaagagccagacggacgccgcaccagcggaaaggcgacaagacacgagagcaaggaacgaagaacagaagaagaacaacagccgagcccaaacagatagacgacggaaacacacaaacaggacaaaaggacagaaaaaaataaccacaacaatctca

SEQ ID NO: 318117 - DNA, 3271 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgaattactaatttcagctggattcaatttgttgtcagttgattctgtagtaaggccatatgttgcccctctggaggtgcttgtcaactactctggatgatggatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgaccgatgcggccagacctcccttttctcttatatacttacgcacgacctaaccaca

SEQ ID NO: 318118 - DNA, 2137 bp, Homo sapiens
tagtgctggcgtgtgatcttgtgctcgatggttggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318119 - DNA, 4463 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctggtaagggcagaggctggagtgcccagggttgtcaaacatactacacatgtactgccattcccgcctggattcagtggcagacatcactaattaggctctttcccttctgaacccttcagcacactctagtgtcatttaaataatactccatttggtatgtcagataggacctatttgccaccccagagaaattgatgacgcctgaaagtgaaattctgaggaactcttccaagatacagtggggtgtacaacctgtatcctttagaatcttgagttggtacagggtggctaattagatggagaagtcagtctcgaagcctgttgcactctgttcatgactagacaagaatcacatatgtatggcgtgctatgtgcctagcactgtgctaattctcccaacaaccacgttaaatgggtgtacctcacgttacagatggggaaactgaggtccagggaggtaaaagtgatttgcccaaagacacccacttggtgtataccaagactggtattggcatctaggcagtctaattccagagcctccactcttagctcccactctgtgactctcagtaatgaaaactggccaggggacaagggatggcattttaagttaagctgtctttctgtgtctccctttagaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318120 - DNA, 3241 bp, Homo sapiens
  misc_feature (3166)..(3166): n is a, c, g, or t
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagtctgttttaacaataagtgccagaaaaaaaaaaaaaaaccggcttgtgtggggaaagagaggccggccaggtcgccttggagnatcgcccatgggtatgactcgttcgtaaactggttaagaacaaaaaagacacacatgacctcagcacaattacgt

SEQ ID NO: 318121 - DNA, 2768 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318122 - DNA, 4362 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctggtaagggcagaggctggagtgcccagggttgtcaaacatactacacatgtactgccattcccgcctggattcagtggcagacatcactaattaggctctttcccttctgaacccttcagcacactctagtgtcatttaaataatactccatttggtatgtcagataggacctatttgccaccccagagaaattgatgacgcctgaaagtgaaattctgaggaactcttccaagatacagtggggtgtacaacctgtatcctttagaatcttgagttggtacagggtggctaattagatggagaagtcagtctcgaagcctgttgcactctgttcatgactagacaagaatcacatatgtatggcgtgctatgtgcctagcactgtgctaattctcccaacaaccacgttaaatgggtgtacctcacgttacagatggggaaactgaggtccagggaggtaaaagtgatttgcccaaagacacccacttggtgtataccaagactggtattggcatctaggcagtctaattccagagcctccactcttagctcccactctgtgactctcagtaatgaaaactggccaggggacaagggatggcattttaagttaagctgtctttctgtgtctccctttagaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318123 - DNA, 1679 bp, Homo sapiens
attaggctaggtacgaggctgggtggtcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318124 - DNA, 2832 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacacactcccgagtcctgctttattgaggcagctatccaggagctcaaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggagtctcaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318125 - DNA, 2784 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagagaagcccttacatgaaggtcttccatgggtttgcatgctggacctctgttcttcccactccaaagtctcttgagacaatcttaactcatctcataacgtctagtaccaacccacatggtaaaaagtgccagtttattttcgtctgcataggttttcttttaggttcgtcgtctga

SEQ ID NO: 318126 - DNA, 3228 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcaggtaaacaggtgaaatttaatgaattcacccatcagttagaccttatgcaaagctttggtgtctgagtttacaaccccggcccactcagcatggtgtggacttcaggggcataaccttactttggtagtcctgaggtacatcaaattcttttattcatctttcccacttgctatactgactgctttaccctgccagcttctaagcacctcaaggagctctttaggcaggatagttgaaaatggagtcttccctttgacccacctatttttgtttctagtttttgtttgagatactcccctgtatgcctaaacatctttgtacatgtctctttattgtagcatcgttttaatagctcaaaaaaaaaaaacagtttagaaagcctaccaataagaaaatgactaaattatagtatttatactgtaaaatgtttcacaccagaaggccgggcgtggtggcttatgcctgtaatcccagcactttgggaggccgaggcgggtggatcacgaggtcaggaattcaagaccagcctgaccaacacagtgaaaccctatctctactgaaaatgcaaaaattagcagggcatggtggcaggcgcctgtagtcccagctacttgggaggctgaggcaacagaattgcttgaacctgggaggcggaggtctcagtgagacaaggttgcgtcactgcattccagcctgggcgacagagcgagactttgtctca

SEQ ID NO: 318127 - DNA, 3105 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcaggtaaacaggtgaaatttaatgaattcacccatcagttagaccttatgcaaagctttggtgtctgagtttacaaccccggcccactcagcatggtgtggacttcaggggcataaccttactttggtagtcctgaggtacatcaaattcttttattcatctttcccacttgctatactgactgctttaccctgccagcttctaagcacctcaaggagctctttaggcaggatagttgaaaatggagtcttccctttgacccacctatttttgtttctagtttttgtttgagatactcccctgtatgcctaaacatctttgtacatgtctctttattgtagcatcgttttaatagctcaaaaaaaaaaaacagtttagaaagcctaccaataagaaaatgactaaattatagtatttatactgtaaaatgtttcacaccatgcccggccattgacagttctttagagcagttgatacggatctttcttatgtaattacagcagtttgtactgagaaataagcaagaattgagctttggtaaggagggttccgaagtcaaggaacatgaaataattgtggaggtgaggtgagaagagagggg

SEQ ID NO: 318128 - DNA, 2794 bp, Homo sapiens
  misc_feature (2758)..(2758): n is a, c, g, or t
  misc_feature (2794)..(2794): n is a, c, g, or t
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaagaggaaagaaagaaccaggctacttntccaatggctctgggttggttttttcccaagcttgn

SEQ ID NO: 318129 - DNA, 2481 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctattatccttggctcctacactccgcatgcttctagacctcaactgtgatcatctccgtc

SEQ ID NO: 318130 - DNA, 2194 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgtttcctgcccccgggaaaggggcggcgcccgggggggaggagggggccggggagaggccccaagaaaattcagcagggcgggggaatggggcgaacccgggcgagggggcacaggggagaaatccaggaacccggggtgccacggagggggaccggt

SEQ ID NO: 318131 - DNA, 1638 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcaggtggatgcattggagatg

SEQ ID NO: 318132 - DNA, 384 bp, Homo sapiens
gagtcacatcagtatgttgttggtgataccattacgatgcagctgatgaagagggagaaaggggtgttggtggctttgcccaaatccaaatggatgaatgtagaccatcccattcatctaggaggtgagttctttaaattttggggacaaataatcctgggtacattctttaaggtgattgaatatatctaagcatcagaaagtgaagcctttgggcagggcacatctggcatgttcatattagtcataggattccagtaggttagggtggggtttgtagagagtagattaattattggtttcaagtttgtttaatctatacatcctaatttttcattttacaaggttttattacatagtgtctttcactgtgcccaatcttag

SEQ ID NO: 318133 - DNA, 4202 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgaattactaatttcagctggattcaatttgttgtcagttgattctgtagtaaggccatatgttgcccctctggaggtgcttgtcaactactctggatgatggatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagcaaaaaaaaaaaggcgggcccccattatagtgtggcacatttaaacagcatattatgagcaacactggcaaacacccaactaccttgcaagggccaacacaacaagcaacaaaacaagggggcgacaaatccaccgagccacgacgcccatgggcacggcccgagggtcaatagagcagcacgtcaccgcgacgtccgcattggccactgggaatgccccgaacgcgaacatagacacggggcgtgaacacacagagcgggcagacaaagcaccgacac

SEQ ID NO: 318134 - DNA, 3834 bp, Homo sapiens
cggctggtacagcctcggagttacgggatcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318135 - DNA, 3136 bp, Homo sapiens
ggccatatgttgcccctctggaggtgcttgtcaactaagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318136 - DNA, 3028 bp, Homo sapiens
ctgattcattctcattctctctaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318137 - DNA, 2696 bp, Homo sapiens
  misc_feature (14)..(14): n is a, c, g, or t
ggccgcgcggtgantcggacgaggctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318138 - DNA, 2641 bp, Homo sapiens
  misc_feature (61)..(61): n is a, c, g, or t
ttatgcacagaactgtaacagatgggacatttactccacgtcttctcactcagtgaaaganagcaggatcatgcccagcagaagatgtgtccacaacgggttatcttggctgctgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318139 - DNA, 3723 bp, Homo sapiens
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318140 - DNA, 1787 bp, Homo sapiens
  misc_feature (2)..(2): n is a, c, g, or t
anggaccccgcagcttaagggctaccccctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318141 - DNA, 2980 bp, Homo sapiens
  misc_feature (2828)..(2828): n is a, c, g, or t
  misc_feature (2831)..(2831): n is a, c, g, or t
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgagnaangggggagcggcacaacgggtctgtccgccctgccccagtacatggccggacctcccggtggttggtccccgttgggcggctttcgggacaccggggggtcccgggccttggccttcctaaaaggcgccccctctgtgtggtttcttcgg

SEQ ID NO: 318142 - DNA, 2733 bp, Homo sapiens
  misc_feature (2728)..(2728): n is a, c, g, or t
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagatgctgaggggttggaaaagcaaagcagatgtgttggccaaactggtccagaagatgagaccgtattccctgccctgtggaaggggggagatgtattcgacgggccgggccgtttaatctcccattgtagctttgaagggaccttaccctgaaagggggaaaaaaaacgtttcctccagaagcgcgcccctgtggtcccgggcttaacggggggaagtcanaaagt

SEQ ID NO: 318143 - DNA, 1335 bp, Homo sapiens
gcggccgctccaacatcagaatgagggactgccctgactggcagtgggtgacagagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagca

SEQ ID NO: 318144 - DNA, 2924 bp, Homo sapiens
  misc_feature (2849)..(2850): n is a, c, g, or t
tctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggagtctcaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattaaacttgnnacctaacacatccaatcctcaaatcttaacccttatctctatccacaatccccccctttcgccctttcctcgct

SEQ ID NO: 318145 - DNA, 2385 bp, Homo sapiens
aacataggctaggtcgaggctgggtgttaatcggccgagggactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggtctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaaggttagtgtgttcctgttactaagtggctgccgttcctcaaatgctgtcattgagctggtaggcattactgtgagatctaaaccttctcaagagaagaggggacaatgagtattttctgtatgcttgttattagttctttccccaggggtgttaaatcagtgaacacgacagctaagataaacatctagggagcttggctcttaggtctgcatttgccacattgctttcggaaagcaggagatatcctttctgttgacttagagtttgctgcaggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaaggtgagggtgccggaagagagggctgggttgccgcagaggtgtttcagaggtgacccggtgctctaagcagaggagcgccactagatcctgtggctt

SEQ ID NO: 318146 - DNA, 845 bp, Homo sapiens
ttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaaaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318147 - DNA, 277 bp, Homo sapiens
tagtgcaggtggctagtatttgttcgaactatacacctgcgtgacactcatataatcgagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318148 - DNA, 265 bp, Homo sapiens
gtaggaatgaagctcatgcttttttatgtaacgagccccccacctcagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318149 - DNA, 395 bp, Homo sapiens
ttttgactgtaggatttactgcttactacgtaatttaaatattagcatatataagttttactataaaatgacatgacataaattatatttttatgtaaatatattttaaatatttttcagaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318150 - DNA, 280 bp, Homo sapiens
tatatcgtattacaatattttatctttaaggacgctaaaaaaaaaccttatgatggaaacgagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318151 - DNA, 271 bp, Homo sapiens
aatgcggtatgaccgtaggtttactgttagaaagaacagccccaccccccttataataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318152 - DNA, 279 bp, Homo sapiens
  misc_feature (43)..(43): n is a, c, g, or t
  misc_feature (45)..(46): n is a, c, g, or t
tacgcaataatattggtccctgtctgcgtgacaagaagcccanannccctagtagacacgagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318153 - DNA, 273 bp, Homo sapiens
gatgcagaagtccaaggtgtaaacaaggtgcagtggcgggcccctcagataccgagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318154 - DNA, 264 bp, Homo sapiens
agttagtatgcggtttctattaaggttgaacgacgctgctctccctcaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318155 - DNA, 1293 bp, Homo sapiens
agaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgttgttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaattttagtattttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctttctgtctgcaccattgggcttgaaaactttgatcaggaagctgtcagacctgtaccg

SEQ ID NO: 318156 - DNA, 677 bp, Homo sapiens
cgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattg

SEQ ID NO: 318157 - DNA, 310 bp, Homo sapiens
ttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggc

SEQ ID NO: 318158 - DNA, 5016 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318159 - DNA, 5054 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318160 - DNA, 5223 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtcca

SEQ ID NO: 318161 - DNA, 5074 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318162 - DNA, 5041 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318163 - DNA, 5121 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggggttcagagggacacctacagtcagttgaaaggcaagaagagacaagcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318164 - DNA, 5016 bp, Homo sapiens
  misc_feature (978)..(978): n is a, c, g, or t
  misc_feature (992)..(992): n is a, c, g, or t
  misc_feature (998)..(998): n is a, c, g, or t
  misc_feature (1002)..(1002): n is a, c, g, or t
  misc_feature (1005)..(1005): n is a, c, g, or t
  misc_feature (1026)..(1026): n is a, c, g, or t
  misc_feature (1028)..(1029): n is a, c, g, or t
  misc_feature (1044)..(1044): n is a, c, g, or t
  misc_feature (1055)..(1055): n is a, c, g, or t
  misc_feature (1057)..(1057): n is a, c, g, or t
  misc_feature (1073)..(1073): n is a, c, g, or t
  misc_feature (1086)..(1086): n is a, c, g, or t
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgggtatnccaacgcatggccntcgtcngatnccnggggggagggtcttggggctngnncaatgacttggacgnggttatagganangtggggcggccaatcngaagactatacanccgcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318165 - DNA, 5807 bp, Homo sapiens
agaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgttgttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaattttagtattttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318166 - DNA, 5865 bp, Homo sapiens
agaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgttgttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaattttagtattttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318167 - DNA, 4549 bp, Homo sapiens
ttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaaaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318168 - DNA, 4546 bp, Homo sapiens
cgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318169 - DNA, 4036 bp, Homo sapiens
gattgcgagctcggacccagatctgtcgtccatcagaagactatgaaccctcctaggaaagctgtagaggaaccccttaatgcattcaaagaatcaagaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318170 - DNA, 3983 bp, Homo sapiens
  misc_feature (41)..(41): n is a, c, g, or t
gcgactcaccccacaatattctcccaatttagagattaagnaaaacccttgatagacacgagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318171 - DNA, 1337 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318172 - DNA, 2994 bp, Homo sapiens
tgtgttgtatgagtgtgttataaatgcatattgtgttgtgagtagcatatattgggtatgtgttgtataggttgcatgtgttgtgtgtgttgtgtgttgtcagtgttgtatatgttgtatgagtacattgtacatgcatgttgtgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318173 - DNA, 1893 bp, Homo sapiens
  misc_feature (1893)..(1893): n is a, c, g, or t
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgtaaaaaaaaaaaaaaaaaaaaaaaaaaaaaaaaaaaaaagggagaaggaaggacgcagaagagagctcccataaggatgccacaaaggggggcgcaaaaacacagaggtgtgatactcgaaaaaatggtgggccacaataagtggagcgagcaagagtgaaacacgataacaacaaccggcccggcacctgtcgacaacgcatacaaaccgggcggacatagccggccaacacagggcgcaaggtagggagagagagtgatacccacacacaaggcccgctagcctgccagtatacccacccacgctggggggacacacaccgtgcggcaaacccaagagactatcaccaacgaagtataagagccgccacaaactgagaagcaacctcccaaacaaagccacaaacgcggcgcgaaaaaacagcggccgcgacaatgcggcacggcaacctgagagacagggccagacaacaacccgcacaccagccgcgacgacacatcccaccccgctaacacccagaagn

SEQ ID NO: 318174 - DNA, 1280 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318175 - DNA, 1648 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgtaaaaaaaaaaaaaaaaaaacaaaaaacacaggagaaaaaaaaaaaaaaaaaaaaaaaaaaaaaaggggggggggggcgagtcatgatatctaccccggcgggggggaaccacatatgacgccaccacccctattttttttagacaaggacggggcccccacagaggagggcgtacattaaaacgaacgcgcggcgcggcgctttataaacaaactgctgggcgagagaaaaactacgtcggcggactttctggggagaaccccccctgcgggcgggcaagggcgaacccccaccagagtatgaagagcgcggcggactacaaatggggtgctgtgtgcaaccgcagtctttggcgcggagaagtggca

SEQ ID NO: 318176 - DNA, 906 bp, Homo sapiens
atcagccggaccagcaggctgggcccagattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318177 - DNA, 2103 bp, Homo sapiens
agaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgttgttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaattttagtattttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318178 - DNA, 2161 bp, Homo sapiens
agaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgttgttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaattttagtattttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318179 - DNA, 2128 bp, Homo sapiens
agaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgttgttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaattttagtattttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctaggaaagctgtagaggaaccccttaatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318180 - DNA, 1312 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318181 - DNA, 1370 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318182 - DNA, 4970 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318183 - DNA, 4733 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatgcgccaattatacacaaaggcattggtgtgtatagaccacaacggtatttatataacactcttaataagagcatccatggtggttgtgcgg

SEQ ID NO: 318184 - DNA, 4984 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgtttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagcta

SEQ ID NO: 318185 - DNA, 3591 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttatttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtgacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgatatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtcctactatcttcgtcactgccattccgattttaatgtatactcaggaacagctcatgaccatgata

SEQ ID NO: 318186 - DNA, 1824 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggaagcgtcgcgcatacgcttccatcaacctcatcttcag

SEQ ID NO: 318187 - DNA, 1835 bp, Homo sapiens
  misc_feature (1835)..(1835): n is a, c, g, or t
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgtaaaaaaaaaaaaaaaaaaaaaaaaaaaaaaaaaaaaaagggagaaggaaggacgcagaagagagctcccataaggatgccacaaaggggggcgcaaaaacacagaggtgtgatactcgaaaaaatggtgggccacaataagtggagcgagcaagagtgaaacacgataacaacaaccggcccggcacctgtcgacaacgcatacaaaccgggcggacatagccggccaacacagggcgcaaggtagggagagagagtgatacccacacacaaggcccgctagcctgccagtatacccacccacgctggggggacacacaccgtgcggcaaacccaagagactatcaccaacgaagtataagagccgccacaaactgagaagcaacctcccaaacaaagccacaaacgcggcgcgaaaaaacagcggccgcgacaatgcggcacggcaacctgagagacagggccagacaacaacccgcacaccagccgcgacgacacatcccaccccgctaacacccagaagn

SEQ ID NO: 318188 - DNA, 1417 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggggttcagagggacacctacagtcagttgaaaggcaagaagagacaagcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgt

SEQ ID NO: 318189 - DNA, 1239 bp, Homo sapiens
gcgggcggggagcaggcgggggagcgggcgggaagcagtgggagcgcgcgtgcgcgcggccgtgcagcctgggcagtgggtcctgcctgtgacgcgcggcggcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcgtccatcagaagactatgaaccctcctaggaaagctgtagaggaaccccttaatgaataactgaagtgaagtgatggactccgatattggagagtcgtaagacgtgacaggcacccagcttatctttaagcatccgtgaacctcgatgatccctctgttgggccgaccgcccctt

SEQ ID NO: 318190 - DNA, 619 bp, Homo sapiens
gttttgtgtgtttgagggttagggagcagggcagctgccccctgtgtctcaattgttgattagtattttgtgactcgggtaggaaaacttctggctcaatttgtctgatatttttatttcccccccatagactgaggctgatgtgaatccaaaggcctatccccttgccgatgcccacctcaccaagaagctactggacctcgttcagcagtcatgtaactataagcagcttcggaaaggagccaatgagggtaaggcagccacaggatgctctgggggaatgttaaaggcacctgttaccatctggggcctctgatctgatttccagtttgggaggagggctagctgctctcgtctacaaccagtgggaggactttggcattagatgctaaagctgatgggctaagaattttttttagacccaccaattgttaacattttgccacatttaccttctttttcactctataagtgaattttatttttgctgagccatttgaaagcagttgtggagactgtatagtggctgtatgacctcaccagagccatcagaaggaaagggatattaatgctttttcagcatcccttatacggtggatacttaacattcatgaatttc

SEQ ID NO: 318191 - DNA, 1498 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318192 - DNA, 2088 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatgaaaaaaaaaaaaaaaaaaaaaaaaaaaaaatttttgggcgcgcgacccgtgcgcgccctcccgaagaaagtttcttagaacacccatatcttgatttgggcggcgcggggcccccaaggtatgaggttaagagtgagacaaacgtgggacaaaacgtcgtgtttccctagaagaaacaccgggtgcctagaacaccagaggggcgggaaatattttccccaccatattgaaagaaagcgccccgcggagcggcaccccgggaggcttttggtgaaaaaaatctcccgacatagggggatttccagagaggatcactctcagcgggactctttttcacgagcggggagttccccaaggcgaactgcgcaatattccacatattaaggccccccgctctggggagacccccaaccccacgagacacacacaagcaccaaccagacagaaaaaacacgaaaaaccaacaaaacgacaaacaacacacagcacaccaccaccacacacagacacactaccaagaaaaaacaaaccccacaaccaaccacaaacgaacacaaaccacagaacaaacgaaaacacaaaagcacaaca

SEQ ID NO: 318193 - DNA, 1655 bp, Homo sapiens
  misc_feature (12)..(12): n is a, c, g, or t
  misc_feature (20)..(20): n is a, c, g, or t
  misc_feature (22)..(22): n is a, c, g, or t
aatcgctaggtncgaggcgngngtaggcggaacgcagccatgttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318194 - DNA, 1730 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318195 - DNA, 2104 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatggaggagatctcccatgggtctgcgcttagtgcccgccgcgagtcacacgcgccagggacctagaggagcctttggcatttgggggctgtggggaacatgaagtgagcgcgactcacggcctggagtgcaggaaaggcttctcctgcaaggcggtggcttcaaaaaccagaagtctggtagcaccacgtgcggcgtctctaaactcttggtcgtctctgacttttaaacatctagggaaagttctaaaacgtgtgtcctggcgtagtagttttggttggcacttggtgaggagggaagaatttgtaaagcactgtaacttctatagttaatccttccagtggagcttggatcccggcggtagcactccccacaaacctcctcccatgcattttgaagcttagtacgtggctgagcctagaacttgaagcttccaaactcagtgctcgctttaacgcagctccctgaaacgttttggaatcggatggtctcaggttgaactttgcagttttcctcaactgtaaaatggggatgacagtgcatgagggtgttgtgaggatcaaatgaaataaagcatggtaaacatctagtcctgatgcttggtacagaactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318196 - DNA, 2079 bp, Homo sapiens
catacgaaatctacgatggcgtgggaccctgggattcggatcaacctctcctacccaccctacctcaccccacccccgttgctggggttcaggaggagatctcccatgggtctgcgcttagtgcccgccgcgagtcacacgcgccagggacctagaggagcctttggcatttgggggctgtggggaacatgaagtgagcgcgactcacggcctggagtgcaggaaaggcttctcctgcaaggcggtggcttcaaaaaccagaagtctggtagcaccacgtgcggcgtctctaaactcttggtcgtctctgacttttaaacatctagggaaagttctaaaacgtgtgtcctggcgtagtagttttggttggcacttggtgaggagggaagaatttgtaaagcactgtaacttctatagttaatccttccagtggagcttggatcccggcggtagcactccccacaaacctcctcccatgcattttgaagcttagtacgtggctgagcctagaacttgaagcttccaaactcagtgctcgctttaacgcagctccctgaaacgttttggaatcggatggtctcaggttgaactttgcagttttcctcaactgtaaaatggggatgacagtgcatgagggtgttgtgaggatcaaatgaaataaagcatggtaaacatctagtcctgatgcttggtacagaactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318197 - DNA, 1747 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatggaggagatctcccatgggtctgcgcttagtgcccgccgcgagtcacacgcgccagggacctagaggagcctttggcatttgggggctgtggggaacatgaagtgagcgcgactcacggcctggagtgcaggaaaggcttctcctgcaaggcggtggcttcaaaaaccagaagtctggtagcaccacgtgcggcgtctctaaactcttggtcgtctctgacttttaaacatctagggaaagttctaaaacactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318198 - DNA, 764 bp, Homo sapiens
  misc_feature (695)..(695): n is a, c, g, or t
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatcaaaaaaaaaaaaaaaaaaaaaaaaaaccgggggctttatgggggggggggaaaaaggggtaaggaatgggcntgggcaaaaggggttcggagaccacatttttttgggccccagggggtaaattggggggggcccccaaaa

SEQ ID NO: 318199 - DNA, 1152 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatcaacaaacaaaaccacaacacttccaaggactactatgtcagattcgcgcagcaacgccggcacacgacacgggcccactggtccaaaggcggacccgaaccagaacttcgccgccaccaggggacacatccgacggacacaccaaaaaagcacgaccgcacacacaaccacacaacaggccagggttaaccgaggataagaaaccccgaaaagaaaaaacaagcacaaaaacgacggggagaagagaaaagagacaaccacacgggggacacgagagaagaacgaggaaccgacctggacaaagagaaatgaagagacacacaaacaagcactggtaccacagaaaagacccaaagcacaacgggaacaccacaaccacgacagagaccggagcaagaaatctcgacagagaaacaagaaaggacaagagaggggcagagaagagagacaaatcagggggacagtgacatacaaaccaaaaaaaacacactaaacgagaaggagtcaacgccccgagtaccgcaacacg

SEQ ID NO: 318200 - DNA, 803 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctaccagaaaagaggaaattccatgtaataggaagccggagggtgctcgtttcgggccgggacccagaagtggttgagaggggccgcgctcaggtttttgcccaccaccccgctttttggtgccagggggaaagccggggcgccccaataaggagggaaatggcaaaagacgtcaccctgg

SEQ ID NO: 318201 - DNA, 758 bp, Homo sapiens
  misc_feature (631)..(632): n is a, c, g, or t
  misc_feature (635)..(635): n is a, c, g, or t
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatcatctcaannaanaaaaaggccgattacaattactgggcggcgtttacaaagtcgggactgggccctggggttaccaacttattggcctggggacatccccctttgcagatgggggatacgggccgccccgccttc

SEQ ID NO: 318202 - DNA, 697 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggagctatttgccctttcaatagtggatttttcaaatattgtaaactcaaaactacaaaaaccaccttggcat

SEQ ID NO: 318203 - DNA, 1781 bp, Homo sapiens
ggcacagtggctcatacctgtaatttcagcactttgggaggccgaggtgggtggatcacttgaggtcaggagtttgagaccagcctggacaacatggtgaagccctctctctactaaaaatacaaaaattagctaaacacagtggcacgtgcctgtaatcccagctgcttgggagactgaggcaggagaatcacttaaacccgggaagcggaggttgaagtgagccaagatcgcaccactgcactccagctgtgtgacagagcaagactccatctcaaaaaaaaaaaagaagaagaagaagtggtcagattcaggacgtgtttggaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318204 - DNA, 1660 bp, Homo sapiens
cagctacttgggaggctgaggcaggagaatcacttaaacccggctgcttgggagactgaggcaggagaatcacttaaacccgggaagcggaggttgaagtgagccaagatcgcaccactgcactccagctgtgtgacagagcaagactccatctcaaaaaaaaaaaagaagaagaagaagtggtcagattcaggacgtgtttggaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318205 - DNA, 1762 bp, Homo sapiens
actacctccctttgtaaaaaaggaaaaaaaaaaagctgtttttcagtagaataattatgtatgcatgatgcttctgcccagaggtgatataggatactctcactttattcattattatttttttaattttattttatttatttatttatttttttatttggagagttttgctcttttaaacccgggaagcggaggttgaagtgagccaagatcgcaccactgcactccagctgtgtgacagagcaagactccatctcaaaaaaaaaaaagaagaagaagaagtggtcagattcaggacgtgtttggaggataagtggtggatttaatgtagggcttgagaaaatgccattgtgtatgactgactggtgtttgaatcctttatcatatcccagggccggtctaggacacataattgtgtgtgcctaggcattcttcccagtttgttgtggctgccctgcccaagcccacatcacctattagcttcacgtccttctctccgcagccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318206 - DNA, 1445 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgtttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318207 - DNA, 1600 bp, Homo sapiens
  misc_feature (12)..(12): n is a, c, g, or t
  misc_feature (20)..(20): n is a, c, g, or t
  misc_feature (22)..(22): n is a, c, g, or t
aatcgctaggtncgaggcgngngtaggcggaacgcagccatgttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggcgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318208 - DNA, 1443 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggcgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgttataaaatgtagtactaaatctggtttctggattttgtgttgtttttgttctgttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318209 - DNA, 1677 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgttgtcctgggaccaagacaaattcgcctaagataaggagttacgtagaagacagggcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggttgtgtatcatattatctgtgttagcatgtagtattttcagctactctctattgtttttacagggttgctatcccccttcctttcctccctccctctgccatccttcatccttttatcctccctttttggaacaagtgttcagagcagacagaagcagggtggtggcaccgttgaaaggcagaaagagccaggagaaagctgatggagccaggacagagatctggttccagctttcagccactagcttcctgttgtgtgcggggtgtggtggaattaaacagcattcattgtgtgtccctgtgcctggcacacagaatcattcatacgtgttcaagtgatcaaggggtttcatttgctcttgggggattaggtatcatttggggaggaagcatgtgttctgtgaggttgttcggctatgtccaagtgtcgtttactaatgtacccctgctgtttgcttttggtaatgtgatgttgatgttctccccctacccacaaccatgcccttgagggtagcagggcagcagcataccaaagagatgtgctgcaggactccggaggcggcctgggtgggtgagccatggggcagttgacctgggtcttgaaagagtcgggagtgacaagctcagagagcatgaactgatgctggcatgaaggattccaggaagatcatggagacctggctggtagctgtaacagagatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318210 - DNA, 1216 bp, Homo sapiens
tgccgcgcggggccatttccgctgctgcttctgtgagtttttccggtgcacgcgagtgcttctgaaacgtcagctgcgctcccctaggagtgctgagcccgcggaaccgcagccatgactgaggctgatgtgaatccaaaggcctatccccttgccgatgcccacctcaccaagaagctactggacctcgttcagcagtcatgtaactataagcagcttcggaaaggagccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcaggccctggggagagcctgtggggtctccaggcctgtcatcgcctgttctgtcaccatcaaagaaggctcgcagctgaaacagcagatccaatccattcagcagtccattgaaaggctcttagtctaaacctgtggcctctgccacgtgctccctgccagcttcccccctgaggaagagtatacataaaaaacaagatagaacaagaagaaatataaacagcaactctacaataaagaaataaaataagaaaaacaaaaaacaaaaaacaagaaaaaaaaaaaaaaaaaaaaaaaaaaacaaaaagacaaaacccccaaccaaaccacccacccacaggccatccaacaacccaatagaaccacccacaagaaaacaaatataacagaagcaggacagaaaggcaaagagtagagtaggcaccgtgaagaaaagtgccagaaaagatgccaagaaaaaaaagcaaataaaatccaaaacagacgaacaaaaaccattcaaacagccacaaacaaccaataagagtaagaacgaaaggaaaagggaaggaagaaaaagcaagcctaggagcagagaggaataagaaccccgaggagcccaagagcacgacagtaagacagaacaaaagcgaagacaaggagaacaagagggatgcagagaaccacaagggggagagaggtgagacaggggaggggaggaagcagaggaagacccgggagaagaggaaggggcaggaaaagaccagtgaagagcgtgtgaacgaagaagagccccaagcgtgaggggagtggtggggtaagggagggaggggtgaggtagcgccgcgcgaagccagaagcagagg

SEQ ID NO: 318211 - DNA, 424 bp, Homo sapiens
  misc_feature (8)..(8): n is a, c, g, or t
  misc_feature (14)..(14): n is a, c, g, or t
  misc_feature (49)..(49): n is a, c, g, or t
  misc_feature (90)..(90): n is a, c, g, or t
ctcttccntttttntggcaattgtgaatggaactgcattcctgatttgnctttcagcttggctgttgttggtgtatgggaatgctagtgntgtttgtatgttgatattgtatcctgaaacttagctgaagttgtttatcagctgaaggaacttttgggccaagaccgtgacatttcctaggtgtagaatcatgtcatctgcaaacagggatagtttgactataggatggtggagtccaaggaaacagcctgtctctggtgaatgggactttctttggtggacacttggcaccagctctgagagcccttcccctgtgtcctgccaccatgtgggtcagatgtactctctgtcacatgaggagagtgctagttcatgtgttctccattcttgtgagcatcctaataaatctgttccattttgatga

SEQ ID NO: 318212 - DNA, 817 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgtaagtgtggcctctgtccctgcccctgccttggccaaccttgaaaatccccattcacggtcagtgcccttcctctggcccccatctgccctcccaaccaggtgggcctgccctgatggcagattctaacacagaaggctgccattctctccacccactgatgcgcacctgtattacctccaccttcagagctagaccagctctgccctggcctaagtgcaaccacagaacttagacacccacttgacactggcttcagtacttgcacaaaattctggcgtctgt

SEQ ID NO: 318213 - DNA, 3284 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318214 - DNA, 3321 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccaggctggtgtgcagtggcatgatctcggctcacagccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318215 - DNA, 2867 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318216 - DNA, 3000 bp, Homo sapiens
agttttctggcttactgtgtctctctctgtgtgacaggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318217 - DNA, 3192 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318218 - DNA, 3095 bp, Homo sapiens
gatcacttgaacccgggaggcggaggttgcagtgagctgagattatactccagcctgggtgacgagagaaactccgtctaaaaaaaaaaaaaaaaaaaaaaagtcagaacagagtgtttgtggtctactgtgggaagccacattaaaacattcagtggagatggtaacttaatgacttcctttgggttggctcttttagggaggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318219 - DNA, 3197 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318220 - DNA, 3434 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctgcatttgtgtggtgcctgaatcaggtctgcacatgcatccaacatgaagcgaccccaggcttttgggtcccttggagcttaagtctgcggggtctggatgtgtctcctttgcatggttgtgagcctgtagataagaagtgataacagggaa

SEQ ID NO: 318221 - DNA, 2760 bp, Homo sapiens
gcaggtttcgcaggcccagcaaggtgggctgttttttatatctgaggaagcacctcccaggaagagcttgcataggaaacaagactgctgtggcaggctggccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318222 - DNA, 2753 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggttttcttcggtgttttttctaatgcaataaactcatttctgcctgctg

SEQ ID NO: 318223 - DNA, 2420 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggatgactaacctaacctaagtgaactctttagccacaaccctcaccttccctcccttaccccaagcaaggccagtgctggagcagccattgcctccggatcaagggagtaacagcaagtatcaggccggagaaaacaggataaagccattcctccttccacctagatggattgccaatcttctgccatcaattttgggaaacctgcctttgtgcccccgaggctgcctttcctcagcatagctgacttgtcatagtggatgaggtctgggctggagcagtagaagccaaggccttttttctgcaagtaatgatgtaggttatttgcagtctctgtaaccaccatccaggccagtacgcagtatttagctggggaccaagggatgggattccctactctaagaaaatacctttattttaattattattattttttgagacggagtctcgctctaccacccgggaggcagagattgcgatgagccgagatcgtaccagtgcactccagcctgggcgacagagtgagactccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgcagcaccaggcagctagagggagagggtcacctgcttcaaggggtgtgggggcaggtgctggggcaacccctctccagcatgtctcctatgtcccccagacga

SEQ ID NO: 318224 - DNA, 1539 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgccctttggacaggcacttcggcccctcctggactccattcagatccagcctccaggagggagctccgtgggcagacccaacggccagagctaacaggactgcctgggaccgccctgcctcaccagggcttttcctttttaaacaaaacaaaccctaccagatttctattttataattttacatcagagctaacaaccaggggacggctttttaaatttcccagggaaggagaccgtcaggccgcatgtagacaatgctgctaagaaacagaacaaaatgccaccccttctaatagtattatactaatttattaaggctgtcttgtctgtgcgttcacttcggatgctgtttcctaagcgtcctccacactggagaaagggaggggctttgtttaaacagaaagcgagtcacagtttgcgggagccccaacctagaactctttccagagaacactcacgctctacccaagttgccaacacctgtgggacccaggtgagttttagaacatccgtgacccagaaagttactctagtgttaaatgaaccaaaggatttggtgtacatgggaccggtttcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318225 - DNA, 1619 bp, Homo sapiens
gcggagcatctaagtctcagtactgttcatctgtcatttctgccctgttttaaaatttttttctccatctcaaaaaaataaaataatgaagtggaatcaaggtggcaagaaaatttagaatcgtttctgatagggactttcccttatcctaaatgtgttttgaaggcacacgttatttccattgtcattctgactttagaaaggcaggttggggcatgagtgggcattttcctaatgacttgctgctaggaggttataggcagggaacagtctgggagtctctaatccagagagactttcagattccctctcttcacatgaacctccattagttagattttgggaaagtgagcatgaagaagggactcagagctgccaggtacccgagtctcaggtctgacatccttgggccccttctgccacaacttcttgccacttcacggacttgaattatgttgcttcttcctggaagtctggcctgcagcacaggcctttcctctccaaaaagctgctgctcatttctggccccatctgctgctatctttgccatcagccatcacagtttggcatcatcagagtctcagctagaggagctgtcattctgccttagtgtttgcctgcgacctgaccaggggcatgaccagctgggatgtcaagtgacatttgggaacttgtagaggccaaatgattgaaagtttaattcttctcaagacccactgatttgccagtgtgcatggaaataatagattagagcagaaactagcagggactgttgtataatcgtgatctactagcagaattgggcccaaagagaaagaatttctgaggctgggtttcttctgggagggtagcaggttggtcttggccagtgctctgtttcccaccagtgttgttcccttttccagcttgcctggcccggctctgtcttccagggtcctgctccagacccctctgcctggggtctcccctccatccagggggttctgggcatcacagctcctttttttcctttctcctcttccagatccagtttcagctggtttgcttcttccagcaggcacccttaggcccaggagcagctcccctgagagaatttgagtcactcatttccttgaacagcacccccctttatactagcagccatttgtgccattgcctgtgccctagggtttgtggggagagagcgagggatcactgagcagttttcccagagctccatgggaaggcaagctctccctcccaatgggagccccactgtcactaactgtaaactcaggctcaggcttcaactgcctacccccatcctcatatttctgtctgtcccagcacctcaggagcattctcattgtggccggctaactccgcctggatgtgaacaggcaagcacagtgggaaatgagtcacgtacttgtattgcacagtggacacctctagaggtccattggtttaaagggatagggaaggaggagggatgagaccatcaccccctcccagaagtaaatctagtatctgagttttctttatgcccttgagtcaaactaataactgtctagtacggaggtgtttgctggttttcttcggtgttttttctaatgcaataaactcatttctgcctgctg

SEQ ID NO: 318226 - DNA, 909 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggagggacattgcttgggcctccagactctgtggttgatgtggggagtacagaagtcacagaagaaatctttctggagtacctctcctccctgggggagtccctgttccgaggtgaggcctacaacctctttgaacacaattgtaacaccttcagcaacgaagtggcacagttcctgactgggcggaagattccttcttacatcacagacctgccctctgaagttctctccacgtaagtgtggcctctgtccctgcccctgccttggccaaccttgaaaatccccattcacggtcagtgcccttcctctggcccccatctgccctcccaaccaggtgggcctgccctgatggcagattctaacacagaaggctgccattctctccacccactgatgcgcacctgtattacctccaccttcagagctagaccagctctgccctggcctaagtgcaaccacagaacttagacacccacttgacactggcttcagtacttgcacaaaattctggcgtctgt

SEQ ID NO: 318227 - DNA, 525 bp, Homo sapiens
ctgtcccctctctgtcacctcacagtagtcgttgccggtagcgggtgtgggggcgcgagcagcgcagggcggcctctcccccacccctcagcccgggcccgggctcggtccccccctctccctccgcttcgcactcccgtcgggtacgggaaggtccaagccgctgccgggtgcccgagggccgtcgtggccgccgtcgccacgggtcccaatggagccgccgaatctctatccggtgaagctctacgtgtacgacctgtccaaaggcctggcccggcggctcagccccatcatgctggggaaacaactggaaggcatctggcacacatccatagttgtgcacaaggatgagttcttcttcggcagtggtggtatctccagctgccccccgggaactgtgtaagctccttgcgagctgagaccttccatctccatcccctgcacagtgtccggctcatcctaggaacgcaactgatgttaagctgaatgatgagggctctgagaagcatcaagacttgcccaaac

SEQ ID NO: 318228 - DNA, 529 bp, Homo sapiens
tgttctgatacagatattccttcaaacatactttctgccgaaatttttagaggaaataagggcttttcattccttctgattaaaatcggcaagcgctgttctcaacctgtattggccaagtttgcagaaggaaaaacagggtttgcagaagggttgggatgaaatacaaacttgagcagattttctctgaaagaggctttagtcagtttcagtaagggggtaaactcttaacaccagagttctgctttcgtgaatgtaaagattctcctgaaactgtgtaggagccatgtcttttcagtttctccttcccttaaaaatcagttattaatggccagaatggcaaataagcagtgcttttctggtgtatgagacgggggaaatcgcaatcctcacattgagctgtgctcaccattccactgcctagcttgagttattccacatagacgcttgctggtttctcatatatgttctgcaaacctttcaatgtacagaggtgaggcctacaacctctttgaacacaattgtaaca

SEQ ID NO: 318229 - DNA, 356 bp, Homo sapiens
atagttgtgcacaaggatgagttcttcttcggcagtggtggtatctccagctgccccccggtgagtgtcttcccctacactctgtcctgcagtctcaggttcctgggggctcctgtagaccaggagctttgcttctactatggacttctggcattgttcctcaaagccacctgaagacttggctcaataaaacctttcccagacaccccagccagttcctctcctctctgttcccatggcacgtgtgggtccttctgtctcacagagagcatgttatggtgaaatgagctgtttctggttctccacagggaactgtgtaagctccttgcgagctgagaccttccatctccatcccc

SEQ ID NO: 318230 - DNA, 119 bp, Homo sapiens
ggttgcagtgagccaagatcgcgccactacactccaggctggcgacggtcagacccgcctcaaaaaaaaaaatgtcccccaaaactccaaaaattaacaacctccccccgccctgccaa

SEQ ID NO: 318231 - DNA, 440 bp, Homo sapiens
tctaattaacctgttaaccttggcacctttttaaagagggaggtggcgagctatggggtgctaccctggagcagtggactcatgccggatggtggggggtctcgtactgtaggcagtggggagccacaaaaatgctttcaatcagggaagcaacataacccagtttccttttagggagttcactccatctgatggatagccactgaattgaagcgggtgagccggcaggctggggcaccaatgttcactatgcccctggcctgactctccaccagtgaggacctgagctaacgtagtggcagtaggggtggtgaggagctagcagatatgtggaagatgacagctagaggaattggttacattgttaagttgttgaacctgaaaaagaaggaagacacagtggcagttcccagaggtctggttgattgattgggtgggag

SEQ ID NO: 318232 - DNA, 342 bp, Homo sapiens
tctcagagcatggaacacaagaatggcatcgagggaggctcccaggcagtcagtagaagggaagaggagaattaaaggtgaggggagcactttggtctgcattttccagtctcttcctgcccagagcccgggcctccacctgtgcctgagatcctgttccccttcccactcacagacattccctaagccacccgatgttccccagtataaaccaggcccctccaggccacaccctgctgggttattctcatcagtgttcctgctgttttctcctttcctgcaaaacacacacacacacacacacaccctcctctcctgcaaaaacacacatattcccttctc

SEQ ID NO: 318233 - DNA, 376 bp, Homo sapiens
aatgatttctgggcttctggcctgcatcattggagggggtagttgaaccatttactgggacaggaggaccggaaaaggccagagtcacagaggagagaatgaatttattccttgagtaaatatttattaaactcctaccatatacttggctctaatataggcatgggagcagagtcaaaacgaaccaaaatcttgaaattatctagcttatgttccagcttggagagatcaaaaaatgagataaatcaataaactatttagtatgagagatggcctagaacactgcctcctacagtgtagctactcagtaagtatcatggagaaaaggacttagggaaggggactagagaggcaggtgttggggatggagttacaa

SEQ ID NO: 318234 - DNA, 797 bp, Homo sapiens
ctgttccaacaagtctgttgggggtgggtgtgcccagggccctggaacctctttaatttgagaaatatttcagggctaggcgaggtggaagatgtacagaagaaataaatggatagggtgcagtggctcaagcctgtaatcccagcactttgggaggctgaggaaggaggaaagcttgagcccaggagtttgaggctgcagtgagcagtgattactccattgcactctagcccaggcaatagagcaagaccccatctctaagaaaaattttaaaatttagcaataaataaatgccttgtgccttaaatttacagataagcttagagattgtatcgtgtattggaaaacaatacaaagcaatatatagtttaaagagtaaatacaggtcaggcgcagtggctcacgggctggacgtgtggctcatgcctgtaatcccagcactttgggaggccaaggtgggcgaatcacgaggtcaggagttcaagaccagcccggtcaagatggtgaaaccctgtctctactaaaaatacaaaaattagccgggcacggtggctggtgcctgtaatcccagctactcgggagggtgaggcaggagaatcgcttgaacctgggcggcagaggttgcagtgagctgagatcacactgctgcactccagctgggtgacagagtgagattctgtctcaaaaaaaaaaaaaaagtaagtactaggctggccatggtggctcacacctgtaatctcagcactttgggaggctgaggcaggaggatcacttgagtccaggatgtcgagactagt

SEQ ID NO: 318235 - DNA, 393 bp, Homo sapiens
aatgacacgtaaattcttgaagtgtttcattttttaagtcacatctagataaacaagaactttcaacagctgaaagaccccaggcaacaacaatccctatttgttagaaatccaactaaatcagtacagttgtgacaaaaagggtaaagaaaaagagaacaagtaagccgaatgaaggaggcggcaggaagacaactatgggtagaagcagttcccttcaaacaacccaagcaaatcctgcttctttggaacttactcctatttccctcctgcactcattatccctcttgtattgctgctgtaactctcgccatctgaacttatctgctgctttgcattttaattgttttctgagggtttgaaacattttgggaccacagatttcccacctgg

SEQ ID NO: 318236 - DNA, 3275 bp, Homo sapiens
ctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacacttttcatccccatcttaagttttacaaggtgatgtaatcagcttgttgtagtgatgctggccaaatggtgctcagcaggtgagaacaaaaaaaccccagatttcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggag

SEQ ID NO: 318237 - DNA, 228 bp, Homo sapiens
aagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcat

SEQ ID NO: 318238 - DNA, 603 bp, Homo sapiens
tcagaccaccctaccatagggctgctgcagtttgctgaggttctgctccagtctctagttgcctcagtgttttacgtacctgaaggtttcaccagtgaaggctgagaagcagcaaagatggcaaccacctccttcctctggaagctccacccctggtgaatactgacctgttgctggcctgaatgtacctgtaggaggtgactggaaacgccttttaggaggtctcgcccaatcaggagaaatgggatcagggatccacttaaaaaagaagtctggctgctttttggtagagcaagtgtgttgtgttcaaggtgacccttccttgactgaaccatttgtgttctccaaagcaagcaggctggaacagctgattctactgaactgcagagatgatagctgctcctccctccagaagttccatctcagggagagatcagggctctatccatagaaccctggctggagtggctgaagcccctgcagtgactagaaatggattggtgttccacttaaagaagcagtctggccacagtctagcaagatggaccatgctgtactgtattatagtggacactttcttttctgaactgtttgtattctcca

SEQ ID NO: 318239 - DNA, 804 bp, Homo sapiens
aattaaaagcaagtgaatttgttaagtgcaaatggattgcacttaacagaactctgagttctgtgttccccttctctgattatgttttatttcatgggaacactgcactaagcagcacaatttctacaaccatttggggcttcttctatctcctttcatactttccctaccaacagggatgtacaattaaaatggctcagcaacaaccctactttttattccccattatgtagggattatatatttgataggtttttccagttttgtgtatacatttacttttttccagaaggagaacttatggattgtgatggaaaatcagaatctagtcctgagcgggaagctgtggatgatgaaactaagggagtggaaggaacagatggtgtcaaaaagagaaaaaggaaaccatacagaccaggtatagtgcctgaggtagacatttcaatatcatcaacacttggttaattaaagaaaaatacaatactgaagacttcaattaaaattaaatattcaggcttcagaactgtctaaacaaaaatatgtgcacataaattaaagaactaaactatttgaatacgactttttagctctagagttctttattttgaatgtgtgaatacttcacaatgaatcattattgaatgccttgtcccaaatgttaaccattttattaaaggctttactagattggcttttgttcatacttggactttgaaggccatttatatagttcctctggatgtgtacttctgtaacgcttttaattttcagtattcactttctaatatctttttttgaaaaaac

SEQ ID NO: 318240 - DNA, 653 bp, Homo sapiens
taactgtttttaattgtaaaattccagacagagatataaaagttggcattaatacaggggaaagaactcaatgcgaatcattacatgccctgtgtttgtgggtattgtgtgtttcagtcaggccctgaaatcacacaagcgtgtatattggtcagccagtgtttgttgcatgggctaatctttttcttcaaggagcatttggcagggtttacctaagtttggctttgaaactgaatttgcatactcatatttaagtagatctacctgcaggccaatagtgttaacataagctagaagaccattttattatcggggaaaacgctgatgagttatttctgtcgtgggccatcctttgaccagcttgagattgtctgtagtctccatcagatggggtgactttgtgtctgctttgcttcttttcagcttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcgctgtaggttaaggcgctgtaggttaaggcgctgtaggttaaggcgctgtaggttaaggcgctgtaggttaaggcgctgtaggtt

SEQ ID NO: 318241 - DNA, 623 bp, Homo sapiens
ccgtgttggtattcacccagttgaggtagttaaccaacttcaggttctcttccaggctggaggcaagcaggggtgaaggacaccaggcttgtcacatcttctgggtgtgctggatgggtgaggacactctcctcttcccttgcctttctgaagtttctcccacctcagaatgtcagtgtgcccatttcctgacacttgggtatttatggccactctcctgccctcttcctaggatgaagtcactagagggcagtagatcgcagcagcactgatttctgtcctctcttgacatttctttgcttaaaagattacaagcctgtttgtcagtgagtctaactgaaccatatctacacaatagttttagaaaattgtatgattctaaggcattgttttcaagaataaaaatatcattggtgtgttttctttggacaggcagaggaaaccccaaaagccactgagtaatgtgcctaattgttttctttggaatcgccctgcctaaatgatacttatcttttatgactacagagaaataaatttcacaagcaatgtattccagctttatgcttccaggacatggagagcgataacctcatcacatcagagtcaaattgaaaggagtgaga

SEQ ID NO: 318242 - DNA, 14516 bp, Homo sapiens
tgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318243 - DNA, 14636 bp, Homo sapiens
tgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctaaaaaaaaaaccactaccctaaaaaaaaaactcgagggggggccccggaccaaattcgccctttgtggagtcgattacaattaactgggccgcgtttaaaacgtcttgactgggaaaccct

SEQ ID NO: 318244 - DNA, 14462 bp, Homo sapiens
tgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318245 - DNA, 14689 bp, Homo sapiens
tgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctaccaaaacacacatcaccaccgccaacacccgaccacactttctttgcgctcctctggcgccctcgaaaaagctttcctgacaacctttcctgggaccggagcgcccccatcatgcatgtccacctgggccataagtctgttcccggagcacccgtgcccgtacacactgccga

SEQ ID NO: 318246 - DNA, 14519 bp, Homo sapiens
tgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgtaaatggtgatcttctaaatctgtgtccacaaattccaaaacccataacactctggtcgacgcggccgcgaat

SEQ ID NO: 318247 - DNA, 14288 bp, Homo sapiens
tgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgata

SEQ ID NO: 318248 - DNA, 14463 bp, Homo sapiens
tgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318249 - DNA, 15250 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318250 - DNA, 15186 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318251 - DNA, 9902 bp, Homo sapiens
aggagcttgtgctcgtaaggggggggggagcgagcagataaattttctgatgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318252 - DNA, 13259 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgctgtcacccgtcaggacagtgtagcatctgactgactagcacgcaccctggtatgctacactagttcgcatctataggatccatctcgataaccggtcactcactaatagggcacctaggctggggttagaccttcgtgaaccagattagttgtaccctactgataatgtggagtggacgcatgctaatcctagtctaccgatacgacgagtgcggcgacatgcgct

SEQ ID NO: 318253 - DNA, 10231 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactggtaagtgtaaatcataaaaacgacaacttttttcttttgttttaaattatacttacagcagattagtaccagcaactgtatttccacattattctacaacctttttattctaaaggaccattttttattttgtcatttctacctctctggaacccatgtttttacttatatctaaactatattaaataataatttgtttactattttttaaaaagcaaaggcatgtattgcatttcatatataacgtgatgtgtagcaactggttattaccacattgagttgatatgactaaagcaaagtaagtaaatgtctatgtactttattgt

SEQ ID NO: 318254 - DNA, 7205 bp, Homo sapiens
tgtgacttttgcagttacccaagcaaaatatgtttgcttctgcagggccaaactgccctctgtgtaacctcaaccacagtcatcagccagtgttttacttcagtacctatgctgtatagaaatgagtaatgatgcattttgttattccagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactgcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318255 - DNA, 5973 bp, Homo sapiens
gaaaaggtttatttgttatcatctacgttctctcccattgactttaagtatgtggccattatttttcagtcaaatacggttgtgaactaatttgaagaaccagtgttttttctttttattgttgtctggtgctatctgttctctcacctaagatgcataggctgtaaagcttttctggagcctgtgaattgtttcagcacacctcatatttcactagttcctaaggggaaccaaaaataactcaccaagaccactatgcagaggctcctatagccatctacaagcatttccttcccttctgcagtaagtaagcaggaataaggggttccccagccccagggaggtcagcatgaggggtaatgctttgccagaaagggctgtggccttactaatgagttctgctctttcctcaagcttcgcagcttactgatttccatactcgagaataacgtttgaagaaaaggatggtgtttttggaaaaccagcattgacaccactctatcttccctacttatttaataccttttagtgccatgttaggatgacgcgtcatagcttggcactgcatgaactaaaaaccaaatatgcaaattgttcacttattttttaccctttccaattacattagcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaagcagaataatttaagtaatcctccaacaccccctgcctctcttcctcctacaccacctcctatggcttgtcagaagatggccaatggttttgcaacaactgaagaacttgctggaaaagccggagtgttagtgagccatgaagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagttcagaatcaagaaggaatgacatcaaaactgagccaggcactttatattttgcgtcaccttttggtccttccccaaatggtcccagatcaggtcttatatctgtagcaattactctgcatcctacagctgctgagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggattcccgagaaagcaccaagagggtagagaaggacattgtcttctgtagtaataactgctttattctttattcatcaactgcacaagcgaaaaactcagaaaacaaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcacttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318256 - DNA, 3032 bp, Homo sapiens
taactgtttttaattgtaaaattccagacagagatataaaagttggcattaatacaggggaaagaactcaatgcgaatcattacatgccctgtgtttgtgggtattgtgtgtttcagtcaggccctgaaatcacacaagcgtgtatattggtcagccagtgtttgttgcatgggctaatctttttcttcaaggagcatttggcagggtttacctaagtttggctttgaaactgaatttgcatactcatatttaagtagatctacctgcaggccaatagtgttaacataagctagaagaccattttattatcggggaaaacgctgatgagttatttctgtcgtgggccatcctttgaccagcttgagattgtctgtagtctccatcagatggggtgactttgtgtctgctttgcttcttttcagcttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggggctgggcctgtatgctgctcgagacattgagaaacacaccatggtcattgagtacatcgggactatcattcgaaacgaagtagccaacaggaaagagaagctttatgagtctcagaaccgtggtgtgtacatgttccgcatggataacgaccatgtgattgacgcgacgctcacaggagggcccgcaaggtatatcaaccattcgtgtgcacctaattgtgtggctgaagtggtgacttttgagagaggacacaaaattatcatcagctccagtcggagaatccagaaaggagaagagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318257 - DNA, 8239 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattgattttgatgcaattacagatcctataatgaaagccaaaatggtggcccttaaaggtataaataaagtgatggcacaaaacaatctgggcatgccaccaatggtgatgagcaggttcccttttatgggccaggtggtaactggaacacagaacagtgaaggacagaaccttggaccacaggccattcctcaggatggcagtataacacatcagatttctaggcctaatcctccaaattttggtccaggctttgtcaatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacaggtaataaataggtttgcaaaatagaaactaccaacaattaatga

SEQ ID NO: 318258 - DNA, 6301 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgagaaggagaacttatggattgtgatggaaaatcagaatctagtcctgagcgggaagctgtggatgatgaaactaagggagtggaaggaacagatggtgtcaaaaagagaaaaaggaaaccatacagaccaggtattggtggatttatggtgcggcaaagaagtcgaactgggcaagggaaaaccaaaagatctgtgatcagaaaagattcctcaggctctatttccgagcagttaccttgcagagatgatggctggagtgagcagttaccagatactttagttgatgaatctgtttctgttactgaaagcactgaaaaaataaagaagagataccgaaaaaggaaaaataagcttgaagaaactttccctgcctatttacaagaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtcctgctgatgacccattagctgatatttctgaagttttaaacacagatgatgacattcttggaataatttcagatgatctagcaaaatcagttgatcattcagatattggtcctgtcactgatgatccttcctctttgcctcagccaaatgtcaatcagagttcacgaccattaagtgaagaacagctagatgggatcctcagtcctgaactagacaaaatggtcacagatggagcaattcttggaaaattatataaaattccagagcttggcggaaaagatgttgaagacttatttacagctgtacttagtcctgcgaacactcagccaactccattgccacagcctcccccaccaacacagctgttgccaatacacaatcaggatgctttttcacggatgcctctcatgaatggccttattggatccagtcctcatctcccacataattctttgccacctggaagcggactgggaactttctctgcaattgcacaatcctcttatcctgatgccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctgattggactactagagtgaagcaaattgccaaattgtggagaaaagcaagctcacaagaaagagcaccatatgtgcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggtacggctgtaagcggccagacggttacgagcacgttgacaccactgatcacccatgtgacgactttacatgggtcatcagtgta

SEQ ID NO: 318259 - DNA, 708 bp, Homo sapiens
ttagatttaagtttctgctacatgatcctattacgtttacatgtttctctgtggctgaaacaaagttctaatcaaaactacttttgctgaagaaaaaattcagcctccatttgggtgtatttttaagcagttattcacagttatcacaaattgtaagcaccaacaaacctgactgaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatcta

SEQ ID NO: 318260 - DNA, 2625 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgatagatggatgcatgcagtttgtcagaacttaaatactgaggaagaagtggaaaatgtagcagacattggttttgattgtagcatgtgcagaccctatatgcctgcgtctaatgtgccttcctcagactgctgtgaatcttcacttgtagcacaaattgtcacaaaagtaaaagagctagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgaggtaatactaatttattttccatgaaatatgtgtgcaagaattaaagcatataaagtaacttttgaaatatgtgtatgatttaccaaagggtaaatcacactgacttagttaacccctgatgtgactgacccttgccatttccaaatgagtgatcttcttagaccttgccttttcaggttctcttcctttcacacattttagaacagacctaccttacagaaatctcaaggagcaccatatctttgaagatcacaggtggggaactacagagggcttgactttagtttgctagataacgacacaaaccttctcagatactgtgagcttggataataccatgtttcagttaaggtagttgatgcatacattctagaaatggaaaagctttcatttaatgttacttcaggtataacttcatattcaccagtgtgcatcataaagtattggtttataaacattttcttgatc

SEQ ID NO: 318261 - DNA, 2074 bp, Homo sapiens
acctgggagctgagatggatcgtttacagccaggtgaggaagtggagatagctgagctcactacagattataacaatgaaatggaagttgaaggccctgaagatcaaatggtattctcagagcaggcagctaataaagatgtcaacggtcaggagtccactcctggaattgttccagatgcggttcaagtccacactgaagagcaacagaagagtcatccctcagaaagtcttgacacagatagtcttcttattgctgtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacagggggcttggagtacccataatacagtgagcccaccttcctggtccccagacatttcagaaggtcgggaaatttttaaacccaggcagcttcctggcagtgccatttggagcatcaaagtgggccgtgggtctggatttccaggaaagcggagacctcgaggtgcaggactgtcggggcgaggtggccgaggcaggtcaaagctgaaaagtggaatcggagctgttgtattacctggggtgtctactgcagatatttcatcaaataaggatgatgaagaaaactctatgcacaatacagttgtgttgttttctagcagtgacaagttcactttgaatcaggatatgtgtgtagtttgtggcagttttggccaaggagcagaaggaagattacttgcctgttctcagtgtggtcagtgttaccatccatactgtgtcagtattaagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtactctagggtttgtttgccttgttagtctttcaagttcagagctttctcataccactttggtttttaaaaattagccacacctatttaattgaataatacacatattctatgatagataccagtaatcagaaaaattttcacatacacattaaatcatttcccccattatgttcgtatgtagcttcctgaattacagtaactgagtaactaagaaaataaaattgagacttttcggggggatttggatttcaggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgataggtattgtgctattttttcatctttttaaagcttttctctttgaaatgtagc

SEQ ID NO: 318262 - DNA, 728 bp, Homo sapiens
ccgtgttggtattcacccagttgaggtagttaaccaacttcaggttctcttccaggctggaggcaagcaggggtgaaggacaccaggcttgtcacatcttctgggtgtgctggatgggtgaggacactctcctcttcccttgcctttctgaagtttctcccacctcagaatgtcagtgtgcccatttcctgacacttgggtatttatggccactctcctgccctcttcctaggatgaagtcactagagggcagtagatcgcagcagcactgatttctgtcctctcttgacatttctttgcttaaaagattacaagcctgtttgtcagtgagtctaactgaaccatatctacacaatagttttagaaaattgtatgattctaaggcattgttttcaagaataaaaatatcattggtgtgttttctttggacaggcagaggaaaccccaaaagccactgagtaatgtgcctaattgttttctttggaatcgccctgcctaaatgatacttatcttttatgactacagagaaataaatttcacaagcaatgtattccagaaaagacctttaacatgtaaatgactttgagtaaagcttgagttaacacctatgctttatgcttccaggacatggagagcgataacctcatcacatcagagtcaaattgaaaggagtgagaaacgatcaagaaagaaaccatatagatgattttttaactgtttttaattgt

SEQ ID NO: 318263 - DNA, 245 bp, Homo sapiens
catgtttctttatttttgccctagtgtcagataatcgactctgtaaccattgcttagaagataaattttttttattaattaaagaataatgttaatgaaccatgttgtaatgagttgatactgcataatttttcaccatgtgccaccttgtgtcatcagtcagttttaattactaacaaaagttgattgcctttaggtctttctggatataaggattctagtcatggtattgcagaaagcgcagc

SEQ ID NO: 318264 - DNA, 500 bp, Homo sapiens
tggagggaagcccctggaagtaagctttctgaccacctgtaggaactgacggggtctgtcagatgttacaatatctaaaatagtttaatgtgttactagatatttaatgttaattggaatccctttatgaggatttctgtttataaatttctttttttggatattagttcgttagagctaatttttttcctgaggttctttaagtctaaataaaatttgttggattttcttagaatctatgtatcatgcaaagaggatttatcctaagtgtgtatttttcttcagtggttcactgttgccttctgggtgaataatacagcatttgcatttggttttagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtggg

SEQ ID NO: 318265 - DNA, 188 bp, Homo sapiens
gcaatctggtagcgctgacatcaaacaaattaactttctgttgctttttccccccatgatggtagttttcttccttaacctaaatatgattgctttttcttttctattttaatagcaaatgcgtcagaaaagtaagcagcaagctaaaattgaagccacacagaaacttgaacaggtgaaaaatgagc

SEQ ID NO: 318266 - DNA, 240 bp, Homo sapiens
tatctgctgtactctaggtttttagcaaatggcttaatatctgagaaaatactgaaattttaaaaaacatatttactatatttaggtcctgctgatgacccattagctgatatttctgaagttttaaacacagatgatgacattcttggaataatttcagatgatctagcaaaatcagttgatcattcaggtatatatgaatactgtttaccctttttctggtttctgatgtgagcgaga

SEQ ID NO: 318267 - DNA, 539 bp, Homo sapiens
gaattacagactttatttctctattttaatcatattgttatatactaagtacaggtaaatagtgctatacatttttgtgtgagtattctgaatgtacctttaaatttattttccttactcttgtagatattggtcctgtcactgatgatccttcctctttgcctcagccaaatgtcaatcagagttcacgaccattaagtgaagaacagctagatgggatcctcagtcctgaactagacaaaatggtcacagatggtaaaatatttgccctacatctaggctttctaaaagacctgagtaaatatgatttttaaagatttttgcatggttataatttaacttctaattatttctgtcagttaaatactattttatatcagtatattgaattagtagctgttaatgtttctttttttttttaatttattctaggagcaattcttggaaaattatataaaattccaggtaaatgtgttttgattttctagttaatgaaaatggcgttccccataccaggaccctactagtcttttaatctt

SEQ ID NO: 318268 - DNA, 4417 bp, Homo sapiens
aagaggcgtcggctccacccctctcagagtcgcggtctgacgcgagatgacagcaacgagttcggtatgtctatgcaaataagcgccctcttgtgggccaatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 318269 - DNA, 4282 bp, Homo sapiens
aagaggcgtcggctccacccctctcagagtcgcggtctgacgcgagatgacagcaacgagttcggtatgtctatgcaaataagcgccctcttgtgggccaatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 318270 - DNA, 3405 bp, Homo sapiens
cgcaaccgtggggaaaggcgcagaggtgggagtgaccggcgccagagaggaagagggcccttgctgagtgaaggggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 318271 - DNA, 4312 bp, Homo sapiens
aagaggcgtcggctccacccctctcagagtcgcggtctgacgcgagatgacagcaacgagttcggtatgtctatgcaaataagcgccctcttgtgggccaatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctcactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 318272 - DNA, 4634 bp, Homo sapiens
  misc_feature (4420)..(4424): n is a, c, g, or t
aagaggcgtcggctccacccctctcagagtcgcggtctgacgcgagatgacagcaacgagttcggtatgtctatgcaaataagcgccctcttgtgggccaatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacagacgnnnnnagaagaaaaaaaaaaaaaaagaaaaaaaaaaaataaaaaaaaataaaaaaaattataaaatataaaaacaaaaataagaaaaagaaaaaaatactagttgtgggggggggcgggccttgtacttttggggaggggccctctccccccgtggggggggggaaaaaaattggcggggggggggggaaagaaaaatggtgggggggggggggg

SEQ ID NO: 318273 - DNA, 1156 bp, Homo sapiens
ggaaaaagttactacacatgctaggctttctcggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 318274 - DNA, 4273 bp, Homo sapiens
aagaggcgtcggctccacccctctcagagtcgcggtctgacgcgagatgacagcaacgagttcggtatgtctatgcaaataagcgccctcttgtgggccaatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataattgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 318275 - DNA, 1493 bp, Homo sapiens
  misc_feature (1279)..(1283): n is a, c, g, or t
aagaggcgtcggctccacccctctcagagtcgcggtctgacgcgagatgacagcaacgagttcggtatgtctatgcaaataagcgccctcttgtgggccaatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacagacgnnnnnagaagaaaaaaaaaaaaaaagaaaaaaaaaaaataaaaaaaaataaaaaaaattataaaatataaaaacaaaaataagaaaaagaaaaaaatactagttgtgggggggggcgggccttgtacttttggggaggggccctctccccccgtggggggggggaaaaaaattggcggggggggggggaaagaaaaatggtgggggggggggggg

SEQ ID NO: 318276 - DNA, 386 bp, Homo sapiens
ttctgacctgggaaatggcaagagggctctgggggcctggaattcctagggacggaatgggagttatcagtggggaccagtgccgagctgacacatgtctgtgtttgccagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtgagtagaggagcagggctaaggaaaggaggaccgtttccttctttatacacacacacacacacacatacacacacatatgc

SEQ ID NO: 318277 - DNA, 347 bp, Homo sapiens
agcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtgagtcacgaggggcagggagagattcgtccttcctggggcaaatcaagcatgctaagagtgtgtttagggctggcaccaagagaacctctttccctgctcagaaggaaggtgaataggggccagagcctgagcgaagcctcttat

SEQ ID NO: 318278 - DNA, 3631 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318279 - DNA, 4334 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaaaaaaacaaacacaaaaaaacaaaacaaaaaaaaaaaaaaaaaaaaaaaaaaaaaagaataaaacaaacgaatagaaaccacagaccaggaggcgggcggacatataaaaataccacacgcggcggagagcaacaatgtatacagacaacccaccaagtactatgcgaaagagcagcggacacaaaagaggagggcggacccattacaaagcacagagcagaccacggcaacgaacaaaaccaacagtagcgaagtaggaaaacagcgagtgacgcacacttaggggaagacgccacaaacaagtggcggaggagcaacatgggggcaaaccccaccaaccagaaaataaaaacgccccggagacaaaaacaaaaagatgaggcgaagcgataaaggggctaaacccacacaagactaaggcaacctggcacagaaaaaaccggcagcccgaagagagataatagacacaacaattaaaagcgcggggaacaaaaaacaaaggaccaacacgacgaaaacaacgacgagaagacacaccaagaagcaaaaaagacagcacagcacccggcagcagacagacgcgaacgaaccacagcgagacaaagcaagacacgcaaaacacaggaacaaaaagaacggatacaaacagcagaacagacagaagaacagacacacaagagaacacacgcagcagaacaccaaa

SEQ ID NO: 318280 - DNA, 3610 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318281 - DNA, 3577 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcagggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318282 - DNA, 3709 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaactagaaaaaaaacaaacaaaaacaacacgacaacacacaccaaacaaacaacagggaaaacaacaggcggcacactgg

SEQ ID NO: 318283 - DNA, 3700 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaagctgcctattgctcgtggggctttgttgctggcccgccccgatcagaggtgcaatgctgggttttggcaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318284 - DNA, 3748 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacaggtgggccttggactggctcactggccacttggtgcacccaggagggaggagggaagtggccaagtgaccacaaagtgtcctgcactctgatgattttcttgtgacctctcttcccagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318285 - DNA, 2731 bp, Homo sapiens
gcttcttttttcccatctcattctttgccctgtctcattgcgggatcatgacttagagcttgctgactcccattgcaccagctggctgggctgttcttctctgggaagtgctggttcacagggccggggagactgtgagcttttcttggagatcctactggaggtcctgcctgtgttcttgccctgtctcagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318286 - DNA, 3080 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttcttccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318287 - DNA, 1714 bp, Homo sapiens
  misc_feature (26)..(26): n is a, c, g, or t
  misc_feature (29)..(29): n is a, c, g, or t
  misc_feature (49)..(49): n is a, c, g, or t
  misc_feature (58)..(58): n is a, c, g, or t
cacttcgatcccgttccgagttcagnaancctagagttaccaagagggntctatgtcncaaggtgggtgggtccagcagcccagtggagaaggaggtcgtggaagccacggacagcagagagaagacggggatggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318288 - DNA, 2174 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggtgagcctccgttgtggttttctcctttaatcctggcagagggtaaggcctgagctcctcctgcccaggtgccaagttcttgattggaactttggtgtgaagattggctggagcgtatcaggt

SEQ ID NO: 318289 - DNA, 1841 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtcagcccagctttctaaggctaccaggttctaggtgcttcggatcccatcctgaatatctcagtctgtgtctgagaatgccctgcagcagataatgttgagcacctgcggagtttggggccctgggggaggctggcatgatggggctgaccccaggtccccaggaagtttttggtgggctggggggtaaggctgagcacgtaagcttatatcatgtcctattggaagtggccttttagccaggccttgaaggattggttggggcagggatggaggagatgtgggtctacggggggcgggccaagacacacagcagcgagagggaaagggcaaagtgaggagaggacagagccccccagagggagactccagcagagaaagggatggggctatcgaggtgaccggacggtgagctcacgagactggagaa

SEQ ID NO: 318290 - DNA, 774 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318291 - DNA, 2668 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatc

SEQ ID NO: 318292 - DNA, 4189 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtcagcccagctttctaaggctaccaggttctaggtgcttcggatcccatcctgaatatctcagtctgtgtctgagaatgccctgcagcagataatgttgagcacctgcggagtttggggccctgggggaggctggcatgatggggctgaccccaggtccccaggaagtttttggtgggctggggggtaaggctgagcacgtaagcttatatcatgtcctattggaagtggccttttagccaggccttgaaggattggttggggcagggatggaggagatgtgggtggtggggaggcagctttgctggaacacagggcattggcaaaaggccaggagtgggatggctggaatagaggaagtgtcttttgaggacacttggctgcagctgtcagaacttgatgccaggcttagcatggctagttcaagttgcttggaccaagtataaggagttttagggtcagcccctggaggtcgggatgtatttaagccattctgggtactgctgggtatggtcacctggcccgttcccttgcttcacatcttctcgggccccacaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318293 - DNA, 3342 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318294 - DNA, 3762 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaattcagagccaggcctggctctgaacttaggggccatcaatttcatcacaacaattatcaatataaaacccctgccataacccaataccaaacgcccctcttcgtctgatccgtcctaagttcagcaccagg

SEQ ID NO: 318295 - DNA, 3535 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaccccccactcagtcactctgtacagataaaggggcctgcttggagtcgacc

SEQ ID NO: 318296 - DNA, 3508 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctcccttccagtttcctcagcctctgcaaggcactcagggtgggggacagcaggatcaagacaacccgttggacccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318297 - DNA, 1639 bp, Homo sapiens
ggctaggtacgagctggggtgtgtaatcggccgagggagagagagaactttcacccaaggagctgctggcactgctgaagtgtgtggaggctgagattgcaaactatgaggcgtgcctcaaggaggaggtagagaagaggaagaagttcaagattgatgaccagagaaggacccacaactacgatgagttcatctgcacctttatctccatgctggctcaggaaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaa

SEQ ID NO: 318298 - DNA, 2291 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggaggaagaagacctggcggcaggtgtgggccgcagccgagttccagtccgcccaccccagcagtactcagatgatgaggatgactatgaggatgacgaggaggatgacgtgcagaacaccaactctgcccttaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacaggtgggccttggactggctcactggccacttggtgcacccaggagggaggagggaagtggccaagtgaccacaaagtgtcctgcactctgatgattttcttgtgacctctcttcccagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggtgagcctccgttgtggttttctcctttaatcctggcagagggtaaggcctgagctcctcctgcccaggtgccaagttcttgattggaactttggtgtgaagattggctggagcgtatcaggt

SEQ ID NO: 318299 - DNA, 1629 bp, Homo sapiens
cgccggggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggcctcttcaccctgctcgtggaagatttcggtgtcaagggggtgcaagtggaggagatctacgaccttcagagcaaatgtcagggccctgtatatggatttatcttcctgttcaaatggatcgaagagcgccggtcccggcgaaaggtctctaccttggtggatgatacgtccgtgattgatgatgatattgtgaataacatgttctttgcccaccagctgatacccaactcttgtgcaactcatgccttgctgagcgtgctcctgaactgcagcagcgtggacctgggacccaccctgagtcgcatgaaggacttcaccaagggtttcagccctgagagcaaaggatatgcgattggcaatgccccggagttggccaaggcccataatagccatgccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatgggccctggggggaggacgaggagtggacagacaaggcccggcgggtcatcatggagcgtatcggcctcgccactgcaggggagccctaccacgacatccgcttcaacctgatggcagtggtgcccgaccgcaggatcaagtatgaggccaggctgcatgtgctgaaggtgaaccgtcagacagtactagaggctctgcagcagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggtaagctgggagcacccttgcaggattctctacttgattctcttgagaggctgcaacaggcaattttcccatgtggttccttggtgttcatccttggcatggctgggtcaagctgcctgggcctgggttgctaggttcctctgcctgatatgaaaaggcccccacaacagcaggagcttagggaggcagggagagctcctttgaatttaatctagttacgtggctgtgggattaaatgtttaggtcacgctccttggtacaacttcatgggttgggttttactggcaaaataaaggcatgtgtttcagggcactctgtttctcttaaaacccctccgtggggttctatccag

SEQ ID NO: 318300 - DNA, 351 bp, Homo sapiens
gggccggggagactgtgagcttttcttggagatcctactggaggtcctgcctgtgttcttgccctgtctcagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggtaagctgggagcacccttgcaggattctctacttgattctcttgagaggctgcaacaggcaattttcccatgtggttccttggtgttcatcct

SEQ ID NO: 318301 - DNA, 907 bp, Homo sapiens
ccttacattggaaaaggtattttaaatttagccttgccgtattatttaaaataccttttccaatgtaagggacaaaaggaacttccttttgtcccttacattggaaaaggtattttaaatttagccttgccgtattatttatagttaggaatttactacattttggtagtctgttttgaaactaagcacttgtgtctgaaagatgcagataatatctatctatttattacacagtgggctctgtttgctgcagaaaagagtgaaacttttaactgcttagcacacttgccagtgaaatatacctgacagagcagaggttataactttggctctaattacttttagtaatggtaagacaacgtgagttttgtttgtttacatgctgtttacaatggcataattttaaaaatatatacaattgagatatttattgcctactattttaaagatgttttatgtgttttcacctttggaatatattgttacatttccttgtacagataattttggtggctttgttaatgtagctagtaatttttatgactactaagtgaccagttttcggtgccttttattgtgggatgcatgattatgtatttattgtacggaagtcactgacgtgtgtatttttgtactttgctgaaagtaatggttgatcctgatgtacatgatgatgaaagacatctttcccaaagggcactgccttgagatcatccttctcaaataaaaagaatgcatttgaaaacaaaaagggggggctaagatcccgagggccagtttaagcgccccgttctgtaaggggccataagcgttataaaaaggaggccggaaaaccgggggaaaatctggtttggaccctcgcgggctaggacaccaaatcagtaaagaagtaaacgtgtggatgtaa

SEQ ID NO: 318302 - DNA, 2449 bp, Homo sapiens
ctgagtttgtgtgatttcaggttatttagagttattaatgtaaacataagaaggcttgtgactcttatcaccctctatagaatataaagactaaaaataaaaactattacctctgggcctgtttttctttgggattagataaagcctttctaccatatcaccaaatactcataaaggctaacacagaaagcttttccaagttaataatttctaaaattaaatatcagggccaggtgtggtggctgacacctgtaatcccagcactttgggaggccgaagtgggtggattacctgaggtcaggagctcgagacaagtcaacatggtgaaacctcatctctgctaaaaatacaaaaactagccaggcatggtgatgcacacctgtaatcccagctactcgggaggctgaggcaggagaattgcttgaacccaggaggcggaggttgcagtgagctgagattgcaccactgcactccagcctgggcgacagagtgagactctgtctcaaaaaaaagaaaaaaaatcaaaataattgtaattaactgaaatgccctgttccttcattcacttgatagacttttctacctgctctatacttggcactcaattagattctggggatacagataaaataagacaaagctcccatctggtagagtccaagtttgttttcacagttatttttccacagtctgtttaaggtattaggaggacttttataaaccgagtgtttttcaggttacttcagagaggagtctccttccacccaaaaaaactaaccaaattattttatcataaagaggtaatcccatttttatgtccacaatttttacatttttgtatcagccaccaataattttgactgttttgtcaagtacatatttcatcaatcctatttccacagccgtacatgtgatcccagtgactgatagatctgtagaatgtgaactcacatttaaagtttattttgggaaggcatatatgccttttgatgacacacacaccaaaatatataagagctgtgcatggtaaacccacagtagaagggaaaaagtaatgctttctggtatacttcagaggctccatttgaagatgtgcgttgatgtttccttgattattttgaatgaggagtaggcggtaatatttaacaggtagcatacgtatctaagcatatagtaaatattactagtacttgtgtgccatgaggcactaatacataggtgaaacaaaaatatttttagttctaaaaaattctctagatatttatggatggttaggcaatagggttccttcatgagaaggaaaaaactgtatctttattgtcagtaagtgtggaaaaaaacccgacttgtatgtgtattcacagtttgataggcatattttgaagtcattgttttccatcaatattaagtatcatccatttctatgttctctagcaaaagaaaattcttagtgtgatacagctttactctttgtttgactttgtacaaggtccacaaaaggaggaggctcaaaagattggacactttaccctgacattcagcacattcattttatctttcgataaagataaccagaaatcatttgcctcttgtttattatcatgttgaaaacacaacagtatagttccttttgtcccttacattggaaaaggtattttaaatttagccttgccgtattatttatagttaggaatttactacattttggtagtctgttttgaaactaagcacttgtgtctgaaagatgcagataatatctatctatttattacacagtgggctctgtttgctgcagaaaagagtgaaacttttaactgcttagcacacttgccagtgaaatatacctgacagagcagaggttataactttggctctaattacttttagtaatggtaagacaacgtgagttttgtttgtttacatgctgtttacaatggcataattttaaaaatatatacaattgagatatttattgcctactattttaaagatgttttatgtgttttcacctttggaatatattgttacatttccttgtacagataattttggtggctttgttaatgtagctagtaatttttatgactactaagtgaccagttttcggtgccttttattgtgggatgcatgattatgtatttattgtacggaagtcactgacgtgtgtatttttgtactttgctgaaagtaatggttgatcctgatgtacatgatgatgaaagacatctttcccaaagggcactgccttgagatcatccttctcaaataaaaagaatgcatttgaaaacaaaaagggggggctaagatcccgagggccagtttaagcgccccgttctgtaaggggccataagcgttataaaaaggaggccggaaaaccgggggaaaatctggtttggaccctcgcgggctaggacaccaaatcagtaaagaagtaaacgtgtggatgtaa

SEQ ID NO: 318303 - DNA, 2718 bp, Homo sapiens
agcggagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggcaatagcgcctttaagtcaccagatgcgttcaaggtgtccctcccactccgcacaaactacctatacggcaagatcaagaagacgctgcctgagctgtacgccttcaccatctgcctgtggctgcggtccagcgcctcaccaggcattggcacccccttctcctatgcggtgccagggcaggccaacgagatcgtgctgatcgagtggggcaacaaccccatcgagctgctcatcaacgacaaggttgcgcagctgcccctgtttgtcagtgacggcaagtggcaccacatctgtgtcacctggacgacacgggatggcatgtgggaggcattccaggacggagagaagctgggcactggggagaacctggccccctggcaccccatcaagcccgggggcgtgctgatccttggacaagagcaggacaccgtggggggtaggtttgatgccactcaggcatttgtcggggagctcagccagttcaacatatgggaccgcgtccttcgcgcacaagaaattgtcaacatcgccaactgctccacaaacatgccgggcaacatcatcccgtgggtggacaataacgtcgatgtgttcggaggggcctccaagtggcccgtggagacgtgtgaggagcgtctccttgacttgtagccgccttctcctctgtccaggaggccgggatcaggctgttgccatggaagttcagggccatagactgccccacttaaactcttgtcagtctgggctcagggttcccagagctcattccccaggaatctctaagaccagggctggggcagtgtctgtcactggcttgtttgttccctaccaatattctgttgctgtttgaagtagtgccagggtcccctgggaagatgcccccaagacacctgccccaagtgggtggatatctgccttcctgctgcaagtggaggcaggtccagcagcccctcttcagagcccctgtaaatgctatcgcagcctgagtcctgccgccttccagttccttggtgtcccgtgcaccccttctgtctgtcccctttcatggctgtgcagccgtcccgctggagtggccatgtcccttgtgcattgagtgcatccccgctggtgactaagctcgcagcaagcggctaccccccgatctgcaaaagggcctctccctttgtgttctatacattgtgaatcttcccgtctgaagaacgcccagcctgcccagacaaagccccgccttccccaaagcagaggggctgtctgtgtctccagaaaggggacatcgggggggaggggggctcagaaaggagaagggctgtgatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgttttttttttttcccaacagaaaagaacagccattagaagaaggctcccattttctgatgttccgccccactgtgaagagtgtgctcgttttaaattcatgttgattcttgtaagcactggactgtcttcatcaagtatttccctacagaactcctcaagaaaacagagatcatttggctagagattgtctgagtgactccaagctactcactgtattggacgggagtagtaatttattttaaagataaagtgactaagtggggaaatttataaagctaaatattatatattttatttttcatacatgtttgaagtgcaaatctgtggatattccatttgtaggaccaagtcgacatgcccatcctgacattgtatgctacgagaactcttctgatgatggaatttcgattaaagtgcactgaaagatg

SEQ ID NO: 318304 - DNA, 2744 bp, Homo sapiens
agcggagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggcaatagcgcctttaagtcaccagatgcgttcaaggtgtccctcccactccgcacaaactacctatacggcaagatcaagaagacgctgcctgagctgtacgccttcaccatctgcctgtggctgcggtccagcgcctcaccaggcattggcacccccttctcctatgcggtgccagggcaggccaacgagatcgtgctgatcgagtggggcaacaaccccatcgagctgctcatcaacgacaaggttgcgcagctgcccctgtttgtcagtgacggcaagtggcaccacatctgtgtcacctggacgacacgggatggcatgtgggaggcattccaggacggagagaagctgggcactggggagaacctggccccctggcaccccatcaagcccgggggcgtgctgatccttggacaagagcaggacaccgtggggggtaggtttgatgccactcaggcatttgtcggggagctcagccagttcaacatatgggaccgcgtccttcgcgcacaagaaattgtcaacatcgccaactgctccacaaacatgccgggcaacatcatcccgtgggtggacaataacgtcgatgtgttcggaggggcctccaagtggcccgtggagacgtgtgaggagcgtctccttgacttgtagccgccttctcctctgtccaggaggccgggatcaggctgttgccatggaagttcagggccatagactgccccacttaaactcttgtcagtctgggctcagggttcccagagctcattccccaggaatctctaagaccagggctggggcagtgtctgtcactggcttgtttgttccctaccaatattctgttgctgtttgaagtagtgccagggtcccctgggaagatgcccccaagacacctgccccaagtgggtggatatctgccttcctgctgcaagtggaggcaggtccagcagcccctcttcagagcccctgtaaatgctatcgcagcctgagtcctgccgccttccagttccttggtgtcccgtgcaccccttctgtctgtcccctttcatggctgtgcagccgtcccgctggagtggccatgtcccttgtgcattgagtgcatccccgctggtgactaagctcgcagcaagcggctaccccccgatctgcaaaagggcctctccctttgtgttctatacattgtgaatcttcccgtctgaagaacgcccagcctgcccagacaaagccccgccttccccaaagcagaggggctgtctgtgtctccagaaaggggacatcgggggggaggggggctcagaaaggagaagggctgtgatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgttttttttttttcccaacagaaaagaacagccattagaagaaggctcccattttctgatgttccgccccactgtgaagagtgtgctcgttttaaattcatgttgattcttgtaagcactggactgtcttcatcaagtatttccctacagaactcctcaagaaaacagagatcatttggctagagattgtctgagtgactccaagctactcactgtattggacgggagtagtaatttattttaaagataaagtgactaagtggggaaatttataaagctaaatattatatattttatttttcatacatgtttgaagtgcaaatctgtggatattccatttgtaggaccaagtcgacatgcccatcctgacattgtatgctacgagaactcttctgatgatggaatttcgattaaagtgcactgaaagatgaaaaaaatacatacaacaacaagggg

SEQ ID NO: 318305 - DNA, 2515 bp, Homo sapiens
agcggagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgagcaccagctcagagcaaacgtgtccaatgctgggctgcccggcgacttccgcgaggtgctccagcagcggctgggggagctggagaggcagcttctgcgcaaggtggcagagctggaggacgagaagtccctgctgcacaatgagacctcggctcaccggcagaagaccgagagcaccctgaacgcgctgctgcagagggtcaccgagctggagcgaggcaatagcgcctttaagtcaccagatgcgttcaaggtgtccctcccactccgcacaaactacctatacggcaagatcaagaagacgctgcctgagctgtacgccttcaccatctgcctgtggctgcggtccagcgcctcaccaggcattggcaccccatcaagcccgggggcgtgctgatccttggacaagagcaggacaccgtggggggtaggtttgatgccactcaggcatttgtcggggagctcagccagttcaacatatgggaccgcgtccttcgcgcacaagaaattgtcaacatcgccaactgctccacaaacatgccgggcaacatcatcccgtgggtggacaataacgtcgatgtgttcggaggggcctccaagtggcccgtggagacgtgtgaggagcgtctccttgacttgtagccgccttctcctctgtccaggaggccgggatcaggctgttgccatggaagttcagggccatagactgccccacttaaactcttgtcagtctgggctcagggttcccagagctcattccccaggaatctctaagaccagggctggggcagtgtctgtcactggcttgtttgttccctaccaatattctgttgctgtttgaagtagtgccagggtcccctgggaagatgcccccaagacacctgccccaagtgggtggatatctgccttcctgctgcaagtggaggcaggtccagcagcccctcttcagagcccctgtaaatgctatcgcagcctgagtcctgccgccttccagttccttggtgtcccgtgcaccccttctgtctgtcccctttcatggctgtgcagccgtcccgctggagtggccatgtcccttgtgcattgagtgcatccccgctggtgactaagctcgcagcaagcggctaccccccgatctgcaaaagggcctctccctttgtgttctatacattgtgaatcttcccgtctgaagaacgcccagcctgcccagacaaagccccgccttccccaaagcagaggggctgtctgtgtctccagaaaggggacatcgggggggaggggggctcagaaaggagaagggctgtgatctccggtcccttcccccatcatccttccttagactgatgctttgactgaatcatcactagctatggcattaaaaggcctctcttctcatctggtgccaaaggttccgttgcagctttttacaaccatccggtgtggtttggaggatttgttttttttttttcccaacagaaaagaacagccattagaagaaggctcccattttctgatgttccgccccactgtgaagagtgtgctcgttttaaattcatgttgattcttgtaagcactggactgtcttcatcaagtatttccctacagaactcctcaagaaaacagagatcatttggctagagattgtctgagtgactccaagctactcactgtattggacgggagtagtaatttattttaaagataaagtgactaagtggggaaatttataaagctaaatattatatattttatttttcatacatgtttgaagtgcaaatctgtggatattccatttgtaggaccaagtcgacatgcccatcctgacattgtatgctacgagaactcttctgatgatggaatttcgattaaagtgcactgaaagatgaaaaaaatacatacaacaacaagggg

SEQ ID NO: 318306 - DNA, 379 bp, Homo sapiens
gcaatagcgcctttaagtcaccagatgcgttcaaggtgtccctcccactccgcacaaactacctatacggcaagatcaagaagacgctgcctgagctgtacgccttcaccatctgcctgtggctgcggtccagcgcctcaccaggcattggcacccccttctcctatgcggtgccagggcaggccaacgagatcgtgctgatcgagtggggcaacaaccccatcgagctgctcatcaacgacaaggtgaggcccgcctgcaccgccaccctccccagaacccatcatgtggtggagggagccacagcccccaccccagccgtcctcgccctcctcgggccacacagcagtgtcccagacatgggactgcggggctgtcc

SEQ ID NO: 318307 - DNA, 2198 bp, Homo sapiens
gaaccactatcctggtggggggcacctgctgcccaccctgcccccagcgtgcctggggggagcacacctgggcatggaggagtccagggtgctgggccacacaagagaggtgggggagaggcctggacagtaggaagatcttgcccagggtcctggatccgccactctgggggtgaccttggacaaacctctgccttggccctcagtctccccatcaaggtttttccattcaggaggttttgggccatcttcagccaccctaccagccctgaaaaggatgtgactcctgtttctgggaagtgtgtggtgtgttaggtgggcctacagccctggttgtggggagggaaggatggagagacagcacagtgacagagcccagactgcaggctggagtgagggttccacttccccgctgctgtgtgtcctggaccagtgcctctgaaccttggcacttggggcagtggatattaacatctttccaagcccaattcttggggcatcagggcctccggtcctctgggaggtggcaggtcctcagattggagatgccatgggggggggaggtgcctctcctttggagggtatggaagtggagacaggagtggcctggcgcagctgccgtggttcttaggggctgggcccggggagcccatggggcttgtgcctagaaagcctgggctcctcactggggtctagatgtgcagacttcatgtctccccagctccagctctgttctctataggtcagcctccacaatgccagaggcccagggctagccccctccacgtccctcctagatctacagctgcccctttgatgacagcgccattgagtcccctgggctgggggggtcatgcaggggtgaggcagctgcctgccgccggtactcattgcctggccaggcaggacacaggctggcgggcactgagagtgggccccacgaaatccattgtcaggttaccaggatgaagaacccaggctggtcgtggagtgcagggcggggcctgccggaagaattatgggcactgcagcaggagggcagcctgggccattagctcctgatgtcatcgatttgggtgaggggacagggaagtcagaggaagctggccagtggctctcacgcagacttacagcagcggagtggtgcctgattcctggtacagctgctcccactgagtctccagggatctgtggttcaggaccccctgcaaccccctcccagacccctgtactggtgggaggagaggacctagaggaaaggtgctgggcagataagcagccgagggaggccctgggtttagcttatcagtcttctgggccctcctgccccaggaagggcagcgaggaccatggtgttgcccctgtcatcgttatcgtcctggccatgagcttgcaggactgggagggccggagtcagccaggcagacggcagcacagcatttgcctgttggcaggtggccttggtggcttcccaaaggcaatcgctccacgcagaacaaaactcacttttttggggggtgaagcaccttggttcatttgtttagttcgttaattccagcagtctgtttctaagggaaacatggctgcagccggtcctgcccctccacccacccaccaggtgcccagtgttcccaagggccccgaatcccaaccttattcaggcgtcagcatctctgcaccccaaatgcctgttagggaggatagtgaaggctgagccctcctgggctcatcaaaagccagcagtgagagaacacccccatctctctgaggtgaccttgtagggcagtccgtgctgtctggctggcctgggtgaggtgggcagggaccaaggcctggcgcctgggcctcgctggccttgctctgcgtgctgacttcatcctgatagtaccttgattttcctactgtgacttccccttctgtcgacttcctcaccaactttaaaattccgtattgagagcagtttcctaagttacctcaaatcctattcagaagaaggttcttcctggaagttgggagggcggaaaacaagtttagtcacagaagactactccatgtttgagcttctgtttcaagggaagtgagtaactgccggaggagccctgcccctctgcagtgtgtggtgttgccctgatacttttcagattgaggtgttacttacatgtaataaaatgcacagacttaagtgtaaaaaaaaatga

SEQ ID NO: 318308 - DNA, 463 bp, Homo sapiens
cagctcataagttttactttgttttgggttttggagtttttagtttctttgatgtttgttttgctttaatttggtttgtggtttgtgtttgcttgtgtttgcttctgcctttcctaccttctgccttttactccctcagttttcagtcagaagtgtgataatcagatgccatcctccatggccacgcttatgtatgcaatataccgctccaaatgaggaccttggtaacccttgaccctttaattctaactaaccatcacccaatcgtaagtggcattatgggaccatgataccacttttctccagtgtcagtgacagagctcagctgtgtccatcacaagaaaaggtggaatgggcagctgtcttgggggtgtggcaagaggcagaacctcttggacacaaatgttatcttcctcataatggctttattcttttggatcctattaaagtacccctgtagctt

SEQ ID NO: 318309 - DNA, 842 bp, Homo sapiens
tgaactcctgaccttgtgatccgcccgcctcagcctcccaaagtgctgggattacaggcgtgagccaccgcgcccagccatttgtcacatattttgatagtaatatgagcatcattaaaaattgctttatttttatgataaattttctggccattgttgtaactggtctaattaatagttatattaatactagtagtatatttcctttttttaaagcacaacaaagcttacaccttttcttattctttggtttctctcctctcagaatgaccaaagagctcaaattcaatttaggaataggtggctaatagttgcttcttagaaaaattagaaaatctattgcataacaaaaggaaatttcacattagcaaaaggaaaaatacctgtaatctcaagtcagagatacaccaaagttctcagttatattcttccagagtttctctatgcctacaagtacaatgttattaaaattcaagctagatacgattgttgaaggatgtgagtttgagtcctgccttctctgttaaaagaagtgtacattatttttttcataaaaatagattatgcagcagtaatatacctactactgtgtcatgaacatctttgttagcaataatggtttacataaatattttaatatggcgtcatcatagttaacctaatgttgcctaaagcatgtaatacatacttctgatgttaggtggtgatattttaggtctatcctgatccagtattaaaaacattggataaatgggtacaatgtacactatttgggtaatgcctaccctaaaaactcagacttcaccactatgtaatatatcgatgtaacaaaactggatttg

SEQ ID NO: 318310 - DNA, 788 bp, Homo sapiens
tgaactcctgaccttgtgatccgcccgcctcagcctcccaaagtgctgggattacaggcgtgagccaccgcgcccagccatttgtcacatattttgatagtaatatgagcatcattaaaaattgctttatttttatgataaattttctggccattgttgtaactggtctaattaatagttatattaatactagtagtatatttcctttttttaaagcacaacaaagcttacaccttttcttattctttggtttctctcctctcagaatgaccaaagagctcaaattcaatttaggaataggtggctaatagttgcttcttagaaaaattagaaaatctattgcataacaaaaggaaatttcacattagcaaaaggaaaaatacctgtaatctcaagtcagagatacaccaaagttctcagttatattcttccagagtttctctatgcctacaagtacaatgttattaaaattcaagctagatacgattgttgaaggatgtgagtttgagtcctgccttctctgttaaaagaagtgtacattatttttttcatatagcaataatggtttacataaatattttaatatggcgtcatcatagttaacctaatgttgcctaaagcatgtaatacatacttctgatgttaggtggtgatattttaggtctatcctgatccagtattaaaaacattggataaatgggtacaatgtacactatttgggtaatgcctaccctaaaaactcagacttcaccactatgtaatatatcgatgtaacaaaactggatttg

SEQ ID NO: 318311 - DNA, 619 bp, Homo sapiens
cttgagactaatctctttcatcctagtaaatttaatgcactaacagcttttacttcaggctgtttgggattaaagattagaatgggataatgtcacagggggtctttagtatccccatctgggcttgtattatttcagggttgaggctttaaaaaccaatgtactttcctcagattacctcctatatcatcaatcgtgccttcaattcccaaacagtgatcaagacagagatatttggctttaaagaaaaagtggagtttgagcctgaagaatctctgagtatctctgagtcccttcttgctcagacaactaagacattttccctgtttctggttattaaaattcatcattggctcaatatttatttgtcaatttgaaattgaacatttagtttccattacccctcaatagtttgttttttaaccagaagccatagctatgttctcgctagtgacaaaatgctaaacaataaaaagtaaagctgcagttatcaaagcaagaataatacctttaggccaggtgtggtggctcacgcctgtaatcccagcactttgggaggccgaggtgggctcatcactaggtcaggagattgagaccatcctggctaacacggtgaaac

SEQ ID NO: 318312 - DNA, 1514 bp, Homo sapiens
tgcttcctgggcgccgtgggcgcggactgcgcgggctgcgcgggtgccgaggagcgcgaggcgcggggaaggcgcacctggggtggccctggcgtgcgggcggcgacatggaggacggcgtgctcaaggagggcttcctggtcaagaggggccacattgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatgacaaggacctgagggaaccaggattcctccctcctaccagatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatga

SEQ ID NO: 318313 - DNA, 1732 bp, Homo sapiens
tgcttcctgggcgccgtgggcgcggactgcgcgggctgcgcgggtgccgaggagcgcgaggcgcggggaaggcgcacctggggtggccctggcgtgcgggcggcgacatggaggacggcgtgctcaaggagggcttcctggtcaagaggggccacattgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcaaaaagctaacatgacaaggacctgagggaaccaggattcctccctcctaccagatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatgaggttctctcttaacttctttggaattagtaaaagctgacaatttgtttctagctattagaatcccaaagtttatagttttcgagcaacgtttcaagtatctctgtcattaagacatagttcatcttaaagtggggatggtggccaaactttgtacattgagaatattgttttgctttagaaaacaagcctgcataaatattatacattacagaagtca

SEQ ID NO: 318314 - DNA, 1460 bp, Homo sapiens
tgcttcctgggcgccgtgggcgcggactgcgcgggctgcgcgggtgccgaggagcgcgaggcgcggggaaggcgcacctggggtggccctggcgtgcgggcggcgacatggaggacggcgtgctcaaggagggcttcctggtcaagaggggccacattgtccacaactggaaggcgcgatggttcatccttcggcagaacacgctggtgtactacaagcttgaggggggtcggagagtgacccctcccaagggccggatcctcctggatggctgcaccatcacctgcccctgcctggagtatgaaaaccgaccgctcctcattaagctgaagactcaaacatccacggagtacttcctggaggcctgttctcgagaggagcgggatgcctgggcctttgagatcaccggggctattcatgcagggcagccggggaaggtccagcagctgcacagcctgagaaactccttcaagctgcccccgcacatcagcctgcatcgcattgtggacaagatgcacgatagcaacaccggaatccgttcaagccccaacatggagcagggaagcacctataaaaagaccttcctcggctcctccctggtggactggctcatctccaacagcttcacggccagccgtctggaggcggtgaccctggcctccatgctcatggaggagaacttcctcaggcctgtgggtgtccgaagcatgggagccattcgctctggggatctggccgagcagttcctggatgactccacagccctgtacacttttgctgagagctacaaaaagaagataagccccaaggaagaaattagcctgagcactgtggagttaagtggcacggtggtgaaacaaggctacctggccaagcagggacacaagaggaaaaactggaaggtgcgtcgctttgttctaaggaaggatccagctttcctgcattactatgacccttccaaagaagagaacaggccagtgggtgggttttctcttcgtggttcactcgtgtctgctctggaagataatggcgttcccactggggttaaagggaatgtccagggaaacctcttcaaagtgattactaaggatgacacacactattacattcaggccagcagcaaggctgagcgagccgagtggattgaagctatcatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatga

SEQ ID NO: 318315 - DNA, 866 bp, Homo sapiens
tgtctgtggaaactggggttccaataagttaaacaatttgagatcaaactccaaattctatgcttgcttttaacataaacatactggattctttgatgtaaatgaaatggtagatctatggcatgctaccatcttgagcatagggagcaggcaagagggcttccaggaatatccagacataaccattggaaggccttagggcactggtgagggacagggaatgggaggaaaaggggacctcatctgataggattctctaactgtaaaccttttatttaataaatacatcattgtatgtttttgtccatgtctcagttgactttctgctggttcaagatgaaagcagacatggctattcaatcactgatttttttcccccttttttctgcctaggggttaaagggaatgtccagggaaacctcttcaaagtgattactaaggatgacacacactattacattcaggccagcagcaaggctgagcgagccgagtggattgaagctatcaaaaagctaacatgacaaggacctgagggaaccaggattcctccctcctaccagatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatga

SEQ ID NO: 318316 - DNA, 812 bp, Homo sapiens
tgtctgtggaaactggggttccaataagttaaacaatttgagatcaaactccaaattctatgcttgcttttaacataaacatactggattctttgatgtaaatgaaatggtagatctatggcatgctaccatcttgagcatagggagcaggcaagagggcttccaggaatatccagacataaccattggaaggccttagggcactggtgagggacagggaatgggaggaaaaggggacctcatctgataggattctctaactgtaaaccttttatttaataaatacatcattgtatgtttttgtccatgtctcagttgactttctgctggttcaagatgaaagcagacatggctattcaatcactgatttttttcccccttttttctgcctaggggttaaagggaatgtccagggaaacctcttcaaagtgattactaaggatgacacacactattacattcaggccagcagcaaggctgagcgagccgagtggattgaagctatcatgacacagacaagagttcctggagaatgggagtgttaagacttttgacttctttgtaagttttgtactgctttggagagtgaatgctgccaagagttcctcagattacaaacagcagtggtgccatttccttccccatcttcatgttacaaacctggaaaggctagaacagccattaggcgtcagcatcttgacttttccccagcatcacaaacagccatttcctcgggcaccaaagtaggttccctttgttggaacaattacactggccatgccataatgttgaataaaactctcttcttatga

SEQ ID NO: 318317 - DNA, 542 bp, Homo sapiens
cagtttgaatctcaaatgcaaagacaagccatgtaggtactgtaaataagtgcaggggtgaaggataataggaattggtggagaatatggcaagctggagaacacacactcacacacctcgtataaactgagtggctaccgcagtgggttatcactgtgcagtaattctggcccagggttgccagaactctcggactttcaagggaagctagaaatggggatattttaaatgtgagatctcccaagttttaaatgctggcaactaagcaacaaatttttaaaaagaccatttgtgttaaaaaataaaataaaaggcacatcataaggccatatacggcctgtgggttaggtttgcaatctcagagtaataaaagaaataacctgaaagtttaaagcagcatagactgtggccagcaagcctaggcgtttggggctcactcacctcggccagtgccgccatccttttattgaatccgatggcatgagaagaaagaacttagactctaaaaaagcgataactacacccaaggaaaagatacaga

SEQ ID NO: 318318 - DNA, 612 bp, Homo sapiens
tttttttgagacggagtctcgctctgttgcccaggctggagtgcagtggcgcgatctcggctcactgcaagctccgcctcccgggttcaagtgattctcctgcctcagcctcccaagtagctaggactacaggcgcccgccaccaagcccggctaattttttgtatttttagtagagacggggtttcaccgtgttagccaggatggtctcgatctcctgacctcgtgatccacctgcctcggcctcccaaattgttgggattacaggcgtgagccactgcacccagcctaccagcctagacctagttttagttcctttttttgcttcactccattgtagcttaggaagctagtttcaattccggattctaccgtctatctgtatgactgggcctttggtcagtctttctaaaatgaagattgctcattttacaaatgagtaaaaactacctgacatgtagtgcaggctttgtaaagcactcatcatgctgcttgtcatactgtaagcactgatatggcataggaaacccaacccccaaacatagcaccttggaagttgagaaaacagcatatactggaaggccactgtcacatctccctcacccgtctctga

SEQ ID NO: 318319 - DNA, 608 bp, Homo sapiens
gaaatacctctgtacactcaccagacactggctgctggttgtcacggtgctaagagctgtgggaaacatgaagagcaatgagaccaggtccctgctctgaggagacgtgtgccagcgaagtttctctcccacgtgagtgtgctacaagaaaatctgaacccgagaatctgattcagtaggtctgcactttctccactttgccagataattctgattgagaccgtcaaggctgtgactagtggggaggcagtagagtattttctgtgctagactgaggcagccctgaagcactgcgcaagcacatggaaaagagaaacgagattgggccgggcacggtggctcatgcctggaatctttgggaggccacggatcacttgaggacaggggtttgagaccagcttggccaacatggtgaaaccttgtccctactaaaaatacaaaaattagcagggagtggtggtgcacacctgtaatcccagctactctggaggctgaggcaaaagaatcgcttgaacccgggaggtggaggttgcagtgagctgagattggaccactgccctccagcctgggtgatagagtgagactccatctctaaataaataaataca

SEQ ID NO: 318320 - DNA, 1350 bp, Homo sapiens
ctggcccgtcctcccacacagaactgagctgctccaagaacgagaaggagctcgaggagctgcttctggaagccagtcaggaatccgggcaggagacactgtgacactttagttcccttttgccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcgcagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttcaaaaaaaaaaaaaaaaaaaaaaaaaaaaaaaaaaaaaaaaaaaaaaaaaaaaaaaaaaaaaaaaaaaaaaaaaggagggggcgcgcgccgccccaaaaattcccccgccgggggcggcgccccgaacgcgccccccccgttttttggcaaaagggggccccccaagggggggtttattaaaacggaaggcgcggggagcgcgcgatagtataataaaacagcgtcgtcgggggcggggaagaaaacgcggctgtgcggggaggaatacctgtgtgggggagggaggggacccccataatagtctggggggggggggaggagaaaatatggtggggcaacaactctccatccctagaaggagatatttgaaacgcgtcctggggaggaagaattaataaaattttcgaggggggattatatggtgtggtgtacacaagacaggagggataatagggcggtggggggaggatgaaagatatttggtgccatacgggaatgatagttttcgaggacaaatttttttacgggg

SEQ ID NO: 318321 - DNA, 1128 bp, Homo sapiens
ctggcccgtcctcccacacagaactgagctgctccaagaacgagaaggagctcgaggagctgcttctggaagccagtcaggaatccgggcaggagacactgtgacactttagttcccttttgccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggcagagggctggggctactcctgtcggtgcaactctgttcacaccttttctaataaactggggctgggttcaaaaaaaaaaaaaaaaaaaaaaaaaaaaaaaaaaaaaaaaaaaaaaaaaaaaaaaaaaaaaaaaaaaaaaaaaggagggggcgcgcgccgccccaaaaattcccccgccgggggcggcgccccgaacgcgccccccccgttttttggcaaaagggggccccccaagggggggtttattaaaacggaaggcgcggggagcgcgcgatagtataataaaacagcgtcgtcgggggcggggaagaaaacgcggctgtgcggggaggaatacctgtgtgggggagggaggggacccccataatagtctggggggggggggaggagaaaatatggtggggcaacaactctccatccctagaaggagatatttgaaacgcgtcctggggaggaagaattaataaaattttcgaggggggattatatggtgtggtgtacacaagacaggagggataatagggcggtggggggaggatgaaagatatttggtgccatacgggaatgatagttttcgaggacaaatttttttacgggg

SEQ ID NO: 318322 - DNA, 889 bp, Homo sapiens
ctggcccgtcctcccacacagaactgagctgctccaagaacgagaaggagctcgaggagctgcttctggaagccagtcaggaatccgggcaggagacactgtgacactttagttcccttttgccggtcggtctgcgatgagctgaggccagagccatgagaatctgctcaccttccccccagccttcctgaggcccaggatgccaggggtgggggccattctggggcccccctccccccacagcaacactacaaggggtgcaggagctacagggagtggccctccgcgcgtgactcaagcacttctatttatgagcccagcactggaagactctgggggtgaatgggaggagggggagcaggaggaggaggaggtctccaaggacatcaggcgcctgttctggaggggccaggcttgccctgcggagggcaggcgtcctgggtggtggtgggatggtcccctgtggccccgggcacagggccgggcaggcagcctggtgccggagaggcggtgcgtgctggtggtggttgagatgcgcagaacagccccagacagcgcaggccgggcagggtggggggatgggagcagaggatcagagctttctttttctcaagtgcaataaatctatcagggagctggggcgggagcagccggcactccgggaccctgctgtccaggccactggaggctgcgccctgagaggcactacagccctttgggggcgagtggcatgggtgtgggtgagggtgggttttatttttctttttctgtgttaacttttgatctagatttttttctttagactttttattgtattacttttattatatgatcatattatgtctctaattgttgcatttttcgttatgttgttgatcatatgctttta

SEQ ID NO: 318323 - DNA, 506 bp, Homo sapiens
acccccaccttctaattctgttattgcaactgcagaccgttacctggcatgctggctgctacctcgctcactcttgtcagagtcggagctacagtcagtgccttcagctctgagctcaggcataccggtccctgtttttgcagttaaggactctaaagtgttgtgacgtgttcatcaagtttttctcaaccataagttaacaattccagtaattgtcatctctcagtcctgattaaacctaattgatttcactagtttttgacccatcatgtgtttgggtttcttctccccagtccctggctctacctcttctgccacaaacgtcagcatggtggtatctgccgaccctttgtccagcgagagggcagagatgaacatcctagaaatcaaccaggaattgcgctcccagctggcagagagcaatcagcagttccgagacctcaaagagaaattccttatatctcaagctactgcctactccctggccaaccagctgaagaaataca

SEQ ID NO: 318324 - DNA, 368 bp, Homo sapiens
tgtccacaccttgcagttgtcacattaagctgtgaaggacgactgactctagcactcagtggtcctcagtggcaggtgatgttgacctcagacaagagttgctcaggagataggctttgcagttcacctcgacaagcgtttgtggagagctaggtctgctacctcctgtatcgttgcctgtgggtgatggtaaggctcttgggggtgtggaagatgcggggatgatgatgatgacgatgatgacgatgacgacgatgacagcgtcgtcgtcgtcctggtcctggaaggataaagtcttgtggagaagaggaggcaattctgacagtttggggttgcatcatcttcttcacagaagagatgaagttgtg

SEQ ID NO: 318325 - DNA, 443 bp, Homo sapiens
ggccagggagagggaagaagagacagaagcagagttaaaatgtcacatagaggtggggcacggtggcttattcctataatcccaacagtttgggaggctaaagcaggaggatcgcttgagtccaggagttagagaccagcctgggcagtgtagtgagaccccatttctagaaaaaaattaaaaattagccgggcgtggtggcacacacctgtagtcccagctacacaggaggcggaggcgggaggatcacctgagcctcagaagtcgaggctgcagtgagctgtgattgctgcactccagcctgggcatcagagtgagacattgtttcaaaaaacgaaaacaaagtcacatagacacagaacacaaaaggggagagccccgcaaagatgggcacagaaacagagagagactgaaacacaggcagaagccagacagggaccttc

SEQ ID NO: 318326 - DNA, 785 bp, Homo sapiens
tggaggggggaggtttttgttgaggagagcgcggccggagagcagagctccgggacccagatcccgaggcatctggaggagaaggacctgaagcccatcttcgaacagtttggtcggatctttgagctgactgtcatcaaggacaagtacaccgggctgcacaagggtgaggggtcgggcaggctgaagaggcttcggggtgggctgggaggctgggggaagttaagccaggctggaggggtggagcggctgggaagggctgatgtggaaggagaagagttcaggcctgaggaaagtggatggaggagctgaaaaagaactcagctagagtgatcaggaaaccccggtgaaggactaaggagggcctcttttggctgaagagttgtcaagacggctgcaaagatgtggatcccagacatatgggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccagtgagccccactcccctgccc

SEQ ID NO: 318327 - DNA, 2524 bp, Homo sapiens
tggaggggggaggtttttgttgaggagagcgcggccggagagcagagctccgggacccagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318328 - DNA, 2296 bp, Homo sapiens
cagggagggcagaaagagggacacctcgagagaacgccgacaggtcaccagccgacagagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318329 - DNA, 2452 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcactcccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcagctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagc

SEQ ID NO: 318330 - DNA, 1359 bp, Homo sapiens
tctcatgggctatctatttccttcctaataccgtttggtttcctgtatggtttgccccctccctcctgtctcctctatccctgctctcatggctgggggtgggggcagatgggtccgtttggactgaggcctgatgatctgccttcctcaggcagccccatcctagatgctgtcactcaccccagccccctcccctcccccagagcccgtgatccgcatcgggggtctcttccccatgcttcacccatgtttcttccttcacaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318331 - DNA, 1501 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcactcccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggtgaggggtcgggcaggctgaagaggcttcggggtgggctgggaggctgggggaagttaagccaggctggaggggtggagcggctgggaagggctgatgtggaaggagaagagttcaggcctgaggaaagtggatggaggagctgaaaaagaactcagctagagtgatcaggaaaccccggtgaaggactaaggagggcctcttttggctgaagagttgtcaagacggctgcaaagatgtggatcccagacatatgggatgtgccttcctgacatactgtgcccgggattcagccctgaaggcccagagcgccctgcacgaacagaagacgcttccagggatgaacaggccgatccaggtcaagccagccgacagcgagagccgaggaggtaggttctgtgcctttggactctgtccctctcctcccacccccaggcccagggcctggagttgtcgaggggtagcctttcttgagggagaaagcctgatgattctgaagagttcccagctgcggtgagataggagtcagtgtggccagagcgggtgagatctggggcgggta

SEQ ID NO: 318332 - DNA, 486 bp, Homo sapiens
gtgtgttgatgtcatgggatgaactcaagaaagaatggagggacaagagagctggtttgggagataagcagctgggtaggggtgtgtgtgtgtgtgcgtgtgcagcaagactgagaatctgagcagcctcagataatattgggatgggggtcaggacacagggtcaggtgttcaatgtggaaagcgtggagctggactgggcagggcagctccaggactaaagagagggactaggaagcagggcatgaaggctggagattggtaaagatctggaaagtgtgggaggcttagaaagttaagagagtgggggagaagggagggtgctcctcaggcctatccaagggctgtgcggctaagtgggggcggtcagggtcagcacttggagagctccacacaccggggatcccaggggccacaccagctccccctccacctggcacagggaagaggcacttccggctaactaactgttcttcccttcccttc

SEQ ID NO: 318333 - DNA, 877 bp, Homo sapiens
ggggtacaggtgcttcctcctgccctgccatcctgggcggggatgatccttcctgttgggctcggccaggaagctgaggtgtagagcggtgaagcgacctgtccagggttgcaagacagtcagacccaagtcttcctaacgctgggctctttcccctcttcccactgctttgtgcatttctgccttctcacttcacaccccatgcccagagaagctctgctccccacctgcctggcctcggcccagaggcccagagaggcactgagggcccccactgtgtgccaggtccacgctcatagtctgtgctgctctccccagcccagagccccgcggcccccgtggaccccctgcagcaggcctacgcggggatgcagcactacacaggtgaggcgccctagccagggcccctgctcaggtgggagaggtggcaggaggaaaagaggcccagtaactgggtctgggcttcttggctccctgccaatcaccctcttcaggctttactgacaagcccaactgtggggaggggtctttaagggcagcacacccaggggtctgaggcagctccttccctgaccacctctcagccctgcaggtgccactggcctgggctaggggaagggagacagggttggctgggagggctcaagaagtcagggaagccccatcagcctctctcttctccccaccccagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggtgctggctggggccttgggagacaggaatgccctcgttatgggcttg

SEQ ID NO: 318334 - DNA, 831 bp, Homo sapiens
tctcatgggctatctatttccttcctaataccgtttggtttcctgtatggtttgccccctccctcctgtctcctctatccctgctctcatggctgggggtgggggcagatgggtccgtttggactgaggcctgatgatctgccttcctcaggcagccccatcctagatgctgtcactcaccccagccccctcccctcccccagagcccgtgatccgcatcgggggtctcttccccatgcttcacccatgtttcttccttcacaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318335 - DNA, 3297 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcactcccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318336 - DNA, 2415 bp, Homo sapiens
cgagtccctcagagctgggatgagcaccctctgcaactataccccattccccaaccatcagcccctacagccattggaccctaagggtagcagaagtagtgttaggagctccagggaagggcggaagaagggctgggaaggcagccaggaggccctgaacatgccctcctcctgtgccctaccacccagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318337 - DNA, 2937 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcactcccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccctaaaactcactgcctcccccaagggccccctctaaggagggtgtgggggagccctgagggctgcctctctgccaagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318338 - DNA, 2769 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcactcccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtgcccagcgtttgtacttgcctcccccaacagtgggcctgttctacccgtgcaggccccaggagagccgcaggggcctgccacacactcccagctcaccctcaccccagcctagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 318339 - DNA, 538 bp, Homo sapiens
tgtgcccagggctgccagcctccaaagcccttcgaggtgccccctgcagctgcccgtgcccccaggaggagccgtttcaaaggcaggcccagatgcttggtgccaccagaggggcttggagcctggacccagagccctagccgaagaaaatgagtccaggcagagaaggtggccgcggctggctgcaaggaagcaatggggaggccagcaaggggacattggcttattccctggcgcatggggcactgatggggactgagcagggcagcaggcactgagtcatgtgtggggcctggcttcaggccaccagccctagcagggaggtctgacaggctcttaaagaactcgaggtggaaaatggtaggtgccacaggagagggacagtttccaaggctgggaaagtcagaagaagacacaagacttctctgggaaactggaattcatggagttgttatttaagaaacccttttccaactcgtgctgaatacagagaggggaagaaaacacaaagctagggaagcagcaagagagagatcag

SEQ ID NO: 318340 - DNA, 550 bp, Homo sapiens
gtggcaacctcaaaaagaagcctcctctccccataaattcctcagtgccccatcaatctccatcaatccatacaagaccagcctcactctgaccacccgggtcttccacatactattgttttctgcaacttgaacaaaataatggattgtagttgatattctccaggggatttgactaccctcacataaaatctctagttaaaaagagctgatttaagtcatacatacaaaaacagcatgatagcatgcaatgtttatcaaacctgagtggaaaaggattgcctggaaggctttttgaaaattgtatccattctcatctctactgatggtgcctgagtaggtctgggcagaattcttggagtgtcaggggattcctgaaggaggtcaacaggaatctcactggcgaaagaagaactgactttggatttagacagaccttggttcagaccttacctttgccatatgcaaacattagaattttgaaagaattgctcattttaatttgacttttcatttcattttgaaaataaaaacttcccttttcatttta

SEQ ID NO: 318341 - DNA, 2716 bp, Homo sapiens
  misc_feature (1315)..(1315): n is a, c, g, or t
atcgaggtatacctacataaagtgtactgatattctgtgtatagcccagtggatttgtacatatgtatgcacttgtgtagccaccacccagatgaagatactgagcaggtccagtaccccagagctaccttcatttctatcactttcccaagctgtcatccccgccggctgtcatgggaaccctgtctgtaagatgcgacagtttgggtaaaggagtttggtcattttaaagagtgtgaaaggcagagaacagagaaatcaaaaccttgcagggccaaggtgggtggagagggtgtttttcttttaacatacatgggcggttttaaggagaaattgaagcagcctgttcagacaattgttttggtatctggccccaggtctgtggttcctaacatgacttgtgatattattttaagtgggcagatggctttttgatagcttctttatctttcgatctcagctcttgcaaaggggaggttggtgctcattgcaagatcagcgataagggtttctttgtaggtcggtggctttcttggtgagtacatttcaacatattattgttttagaacctgtgtgctgccagtgacttgcagcactgttgaagactagccaccctttgtgacctagccctcttgggaaatggcggaggatctcagggtatatcccttacctgtgggagccctatcagagggcttcctgttgaggaaatgttggctgtaggccctctgtgcactgagcacagccacatcaggtgagggcatgggagaagtccgtggtagccatcaggatagagttcagaaacccaaatggctgctttccctgggttgctggaccaggcatttggtaactctaaagcttagagatgattcatcgacaagcatttattgactgcctactgtgtgctgggcacagtgctaggttccagcagggaaagagatgcagagtggtcctaagatgtcacagggcttgtgggatggagtacagaggatttgttgtatgagacctggctgagcccctgctcttcgccaggcacttcactgagtactatattttcatgcaaggtctggtttaattccgacaacattccctgtgaagtagagggttttaaatttctctttcctggatgagcaaactgaggctcccagagtccaaagtcctagggctggtgtggggaaaagccctcctgatcttccttggcacttgacactaccctttggaagtgtcctattcttcttaaaagtaaagaccaagagagcctcaccatggtcttcaagcaccctcccatcccattccccaatctggcctccactggctnatagtcttaacaccagtggtctttctgagctcctgtcaccatggtctttctgttactccaaagggcctcgctcctttctgctgcagggcctttgcccctgctgtttccttcaccaggaacatttatcccgtaccccttgcagtctcctccagtgttgatccctcagttctaagaggacttccccaggggagcctgtccaccccagtgtcctcgggcccctggctttttcatagcactcatcagcccagcacgtgctaagctttgttagagaatgtcccatggcagagcagatgaacatcgccaccagtcgaggggtcatcggccaccctgcctagcagttctactatatttttttgatccactcgtttctcctctgaagtgactctttcaaatgttctttaccttcagactttctctcctgcttcaaaaaacaaaacagaagccataagaatggaactccctataacttgcggcccccaagtctgcacgctgatttccctcccctgtgttacagatgacgaggagtcccttcttgctcaggccacttctccctcctgtgctctgggtcccagtttctgctacttgctctagaatctgacatcatcagtcaccttttctctcctggcaggttttctgctgccctccttgcttgatcctctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaactctctggcccttctctttctcctggctcttcccttagcttcatgtatccaaactcggcatctccacttgactgatggcccaaataattcctcaaactcaccttgtcggggactgcattcatcacctctcccacagtgttcccaagcagcctctcactcccctacctccccacttgctcgttttgcttttcagcatccttaagtaagccctgcctgaccctgtagattgggccagggacccttattctagggcattctttccttttctaaaggcactgatcgcagtttgtagttatatctttattagggggttgctggatgactctctgccccgctagactgtaagctccgtgaggggtagggacatggtctgctttcattcaccactgtattcctgcaggcctgccacagtgcctggcacttagcaggtgctcaataaatgtttgttgaaataat

SEQ ID NO: 318342 - DNA, 280 bp, Homo sapiens
gcacacaccccctacctccctgcctacattccacccagcctgactgctctggaaggaagaatccctgcaaggtgagtgttattatatccatttgtggaccaggactgcggctcagaagcttttcccaggacactgaactctgacaggtgaatagctgccaagtggtggaggttggcctgcagtgagcatcagtctgacttcgaaggacagaatgacacatggtacaagctttctgtcttactgccacacgtcagtgtcctgggagatgaaccagatgcag

SEQ ID NO: 318343 - DNA, 859 bp, Homo sapiens
agaagaggagaaagaaaatggcgctgccaaaacttgtcaactgcgcctgcccagagctcacctgaggtgctcagacgtgaacattcctgtccccgtggccttgggggccgtgacctgtgcactgccacgcagcctcggagccgtgtgcacgcatatgcacgtgtgtatgtgttgtgtgtgtttgcagacgtgtgtccttgtgtgtgtgtgtgtgttgtagcggtgcctggggagtctgacctcagaaggtgctgtggggagggctgcaaggtcctggcgggaggaggcactccccacgcttccccttgggctgggctgttcctggcaggcgagtgctaggcacagtgtgaggttctgtgtggattctgctgtgctccttggcagctctgggggccttcccttgcatttcgaaggaaggggaggcgtgtggctggaggtgagaggccctgaggccctgcctggctcccagcttcccaaatccgcctctctctgggtcgccgccctcagagattgctgaggacacgagctttccacccacgggctgtcctaacggagccgggctaggggcttctggacagaggccgcctgcccctttgggctttggggtttgtttttctcagcagctcacccgggtctctggggtcagggtatcgggcagaaggcagaggacgctgcgcttgggacctgagctctgggcagccctcggggctcaggactcctggctcttctgcccagtttcatgtgttttgtgttttgaaaccacgtgtggtcccacagttgtgccctcagaagccgccgtggctgccgtgaggtagcagtggacgggacgccacggtctttcccatgccatgctgtttcc

SEQ ID NO: 318344 - DNA, 2770 bp, Homo sapiens
ggcggggagggcgccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcctggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccctacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccaaacagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaaccca

SEQ ID NO: 318345 - DNA, 2685 bp, Homo sapiens
ggcggggagggcgccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagccgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcctggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccctacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccaaacagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaaccca

SEQ ID NO: 318346 - DNA, 2669 bp, Homo sapiens
ggcggggagggcgccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcctggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccctacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccaaacagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcgggtccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaaccca

SEQ ID NO: 318347 - DNA, 3331 bp, Homo sapiens
ggcggggagggcgccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcctggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccctacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccaaacagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaacccacactggctcaggtgtccttgctctcaccttgcattggcccgggtgatgccgtctcaccacgggtgggaggactcaaagtagatgggtaactggggttccaactccagagctggaatgccaactgcccactcccagcctggttcagaggaagatgttttgaagaatgagggaaagccaggcacaaagggaagccagggaagcaaagggccctggagtgaagctggtgggctgccgtgtcagagcgcccagggcagggagcagagctcagaagtaatgctggcccgggcgcagtggctcacacccgtaatcccaacgctttggaaggctgaggcaggtggattacttgagatcaggagttcaagaccagcctggccaaaatggtgaaaacccatctctactaaaaatacaaaaattagcgggacttggtggcatgtatctgtaatcccagctactagggaggctgaggcatgagaattgtgtgaacccgggaggcagaggttgcagtgagctgagatcacgccactgcactccagcctgggggacacagcgagactccgtctc

SEQ ID NO: 318348 - DNA, 2853 bp, Homo sapiens
ggcggggagggcgccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtccgtgcgccctggggcgggaggctggggggcgggcggcgggccctcccctgccctttgacccggtcccctgtgccccgcaggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcctggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccctacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccaaacagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaaccca

SEQ ID NO: 318349 - DNA, 2793 bp, Homo sapiens
  misc_feature (727)..(728): n is a, c, g, or t
ggcggggagggcgccgcggcgggcggctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcggacgggtgtctggccgaannccccccccgggttgggtggaaaaaggaaaaaatatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcctggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccctacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccaaacagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaaccca

SEQ ID NO: 318350 - DNA, 2422 bp, Homo sapiens
caggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318351 - DNA, 2111 bp, Homo sapiens
caggctctccacccccacttcccaattgaggaaaccgaggcagaggaggctcagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318352 - DNA, 2171 bp, Homo sapiens
caggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318353 - DNA, 2446 bp, Homo sapiens
caggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggctcctcggcggcccctcccacaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318354 - DNA, 1093 bp, Homo sapiens
ccatacaaatccgctcggttccccttttggggtctttgctcaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318355 - DNA, 1162 bp, Homo sapiens
aatttagagaatccctaattggccgggcgggtctgcgccagctagcggataagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318356 - DNA, 2504 bp, Homo sapiens
caggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaaggtgggcggggcggccaggccagggctgggggcagagctgggggcgtggaggtgggcgctctgagtcacccctctctctgtagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318357 - DNA, 2392 bp, Homo sapiens
caggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318358 - DNA, 2276 bp, Homo sapiens
caggctctccacccccacttcccaattgaggaaaccgaggcagaggaggctcaggtgtggccaatcaccctgcacatcagagttaccctgggcagggcccactgagacctgggaggggccactcgggacctggagggctgggggctgcccgggcgttaggggtaaagctccctacccaactgcgcagaaggcctcagaggcctgggggctgggcttcccctttcacatcgccctttagaggcccacgtgtgggcattggcccgcgatctgaaaggggctgtcctgttcctcatgggcgctgccagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctggctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaat

SEQ ID NO: 318359 - DNA, 221 bp, Homo sapiens
gctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacgggtaagtgaaggtgtctggaacctcgaaggctcacctggcggcgt

SEQ ID NO: 318360 - DNA, 230 bp, Homo sapiens
aaaatatcactcagaacccaagatgcagagacaatgaaataaaactagttttttaaaatgttgtgtgtctcccaacattttttttcttaaacttactgcctattatttcttatgcactagggagcattaacagatgattaagcaaatggaaaattagtaaagaaatattaatggcaagaaaaatggggaaaagctgtgctctactcacatatgttcagttttaaaacact

SEQ ID NO: 318361 - DNA, 271 bp, Homo sapiens
catttggccttgtgtattatttacacgtgtgattcacttttttctaacatgttctaaatacttttttcaagatgttcaatctactttttattaccctctttttgtaaattttaatgatgtgaaaagcacctaaggaccaatggagaagctcagaatagcaatttttgtaggaagtcctgatgaagagtttatcaagggagatttttaagtcagttatgaagcctgagggaaagctagaagtttagggagacctttgatcatacagtattgg

SEQ ID NO: 318362 - DNA, 2098 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtcca

SEQ ID NO: 318363 - DNA, 2372 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttcctt

SEQ ID NO: 318364 - DNA, 2324 bp, Homo sapiens
ggggatgcaactaagttgctgagacaagggaagagagatgaggaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaagactggttcatttctcaattatatagctagttatatattatctgatacttaaaaataattgactaggaaatggtttcataagaccaggattgctgcatgtagacatgctggccgtgcattttccaaatccagaaaagtcctgaacaaaaatttgaatataatagtatcaggaaataggggaaaatagtgttcaacatagtagaaccaagtactcagagtggtgtacaagagtttaggcctctatgctttagatattagtgtccatgcactcttaaagatgaatgaatgcctgacctttcctaaaggaaaacctttttttagttatcacaggtaacattggtgttgcctgtgggggagaattttttactttctccctatttttcttcagcccacctcaaggcaatgtaaataaaagcagtatgtgtgttataataacttatttagttgtttactgtgtgccagtaccatgctaaagaaagattctttatctcacatgat

SEQ ID NO: 318365 - DNA, 1494 bp, Homo sapiens
atatactaaaattggaacgatacagagaagattagcatggcccctgcgcaaggatgacacgcaaattcgtgaagcgttccatattttattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggctttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaatt

SEQ ID NO: 318366 - DNA, 369 bp, Homo sapiens
gtattaagctcaatattagcattaatccatttatttgttaaaatctaatattgtattcttgtcttaaacagtgactttgtttttgtaggctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatcctgtaagtaccaaatatgaatggcaatattattacattttaatttaattaattcaatggcattggcaaggcataattttataatttagctcattagctatgct

SEQ ID NO: 318367 - DNA, 821 bp, Homo sapiens
agatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttggtgagcagaatgctttttgtttagaagtgtggctataaatgtctttgtagttgatgcactctcatctagtaagtaactattatttttgggctctctagaaaggtaattattatctgatataatagtttagtctgtgatgcttcttttaacatatttgtaagttttaaccaaatggttaaagaaatttgctttttaacccttaaacctcacatatccacaagtctctaaattccataggatgctatggatttctagttgcctagttcatgtcttttacttagaaaacgtcagaaaacccaaacttctcgtgacttcaaaaagtgtaattgtacctgaaacttcttttccttcagatttcttatttatgttttctgataggtttttaagattaatcttttcagaaggatgctctaaaaatctggccaatttgattatcctcttccaacttggaaaaaatatgtatttaaaatgagactagaatttgaatgaccttctttcatggaactctgaaaatgttttttggcttgctgtcacaactgacaaatatatttaagaaataacctaaaagaccaatcttaacaatttgactcctagacagaagaaaacaaaaatctttttatacataaaacttactaatcattagtgatc

SEQ ID NO: 318368 - DNA, 215 bp, Homo sapiens
  misc_feature (26)..(26): n is a, c, g, or t
cccatggtcccagtctcattaagccnaagaataggcacaatatagttcctcttcagattctttggcttaatgagactgggaccattggtgatgagaaggcaaacatgttcagaagtcaagtaactggaaaaataaacctccttggcctgatagaaatgatcttactcagtgttggtgtggtgatagtgtgcttccggggacctctagagcgccac

SEQ ID NO: 318369 - DNA, 4663 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318370 - DNA, 4678 bp, Homo sapiens
ggggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318371 - DNA, 4939 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtagtaaatgattcttcacatttgtgcgccagctacatcatgacccttggtaataccgaccaacaggatgaaaattggatatgctttacttttacaaagcacaccttatcttttagttgaagaaatggtggcactatttctttttttgcactaagcaactgcacatttcaaaaggattattgagatgttatgaaaatctctaccttgcacaaaaaaaaacccagcagcttttaaaattcatcatttccacaactgaattgatttccgtttctacagacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318372 - DNA, 4610 bp, Homo sapiens
agatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttgatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318373 - DNA, 2601 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaagactggttcatttctcaattatatagctagttatatattatctgatacttaaaaataattgactaggaaatggtttcataagaccaggattgctgcatgtagacatgctggccgtgcattttccaaatccagaaaagtcctgaacaaaaatttgaatataatagtatcaggaaataggggaaaatagtgttcaacatagtagaaccaagtactcagagtggtgtacaagagtttaggcctctatgctttagatattagtgtccatgcactcttaaagatgaatgaatgcctgacctttcctaaaggaaaacctttttttagttatcacaggtaacattggtgttgcctgtgggggagaattttttactttctccctatttttcttcagcccacctcaaggcaatgtaaataaaagcagtatgtgtgttataataacttatttagttgtttactgtgtgccagtaccatgctaaagaaagattctttatctcacatgat

SEQ ID NO: 318374 - DNA, 4467 bp, Homo sapiens
ggttacaagcatgacttctattaaacctatatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318375 - DNA, 4520 bp, Homo sapiens
gttaattccctggtcttcccaactagcattctgaaagtgcattaacatttgtggccttgtgctctttcatcggacttctaatgatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318376 - DNA, 4678 bp, Homo sapiens
agatgtcaggataaccttaaggatagatgaagggttgagagcctgtgcctcatttctgagttctcagctgctatgccgtggaaatcctgtttactttctgcatctgctcctgcaagactctggagccagtcttgaggtcctacatctccgaaagcaagctcttctagaagttggtgagcagaatgctttttgtttagaagtgtggctataaatgtctttgtagttgatgcactctcatctaatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318377 - DNA, 4545 bp, Homo sapiens
ggggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttgaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318378 - DNA, 4587 bp, Homo sapiens
cttccttcttgttcactggcttggcaagcggcaagcggcaagcggtggaacctgccttcagctacaagaagaggctcataggcggaagggacttgccttgtctcatatgaaactttggactgtggacttttgagttaacgctgaaatgagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318379 - DNA, 2452 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttcctt

SEQ ID NO: 318380 - DNA, 1986 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatatt

SEQ ID NO: 318381 - DNA, 4508 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318382 - DNA, 4634 bp, Homo sapiens
tgagtgttaagtaccatcctctgaagtgtccaactcttgaaggaaaagaaaaagcttccaataccattagatttttcactcagtttttgtgttttgtttcatcagtccaacttaggggcagagaagaagttcaactcagtaagaacttttttgaacttcggtaaaatttgcttaataaattatgttgactgttgcaatattttcaaagcgtcactctaaagcttgccgaagggtcactttaaagtttgccttaaaatcaacagtcgtgtcttcagtattacacactgattctctttgtaaaaggctaaaaagactgctgtaataataatttgttgaaaacatttctgctgcaagtgtatggtaaggttgcaaaggttctcatgaatgaggtacttgggcttggtccttttattctggctgactcaaggctgcaaacaatcttccagaagtgcctgtacttactacaaagacataacccaaacttattttctttttcatagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318383 - DNA, 4301 bp, Homo sapiens
tacccatgcttttcttattttcacaatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318384 - DNA, 3903 bp, Homo sapiens
tactgagtaattcatgtatcccattggaaaaaaaaaaatttcccctaagtagagatctaagtttctgataaatgtttttaatttttttcttattccaagatgtttctaattaacacctggcagtttttattttatgatctggctacctaatggcatcaggtacattgcaataagataaaaggttcaaacaaaacataaacagaattgaacatttcttaaacttagtacttgtcacatttaaatgcatcatattaacagaagtattgaattataataggaaaaagtaatgtaaggaaagggtattctttaaataaggaatgttttattccattgtctttttctattcctaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataaacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318385 - DNA, 1704 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgcgaccattggtgatgagattactccaggtcagaagtc

SEQ ID NO: 318386 - DNA, 3399 bp, Homo sapiens
ggggtcacaagaaaataacccaatggtccttttgaaagtagtacatacacctttaaatggaacttggtctgaagggtgtggaaatgctggtccagggcagatgcacttcagctaccgttccttgcctggtgtgtgcttgtcttgaagcacccttcttatgtgcctttctggaatgggaatgtgttttgccctattggtgaagtccgttagagaacttctctctgcagctagagaaactgaactgattaataaaaagtatgatatctaagatatactgccactctacaggtagtaaatgattcttcacatttgtgcgccagctacatcatgacccttggtaataccgaccaacaggatgaaaattggatatgctttacttttacaaagcacaccttatcttttagttgaagaaatggtggcactatttctttttttgcactaagcaactgcacatttcaaaaggattattgagatgttatgaaaatctctaccttgcacaaaaaaaaacccagcagcttttaaaattcatcatttccacaactgaattgatttccgtttctacagacctggctcaagcacaaaccaatttgtgttgttctgattcaataattggtttctgggtggccaattcagaagaagagtgtacatgctcaacaaatcctaggccctgcattcctgtcatcctcatccgggggaaacaccatcatcccagtagctgccctattcaactgcaacagtctccaggaccatcagtatactgcatttcatgtgcaccaaatattttgaaagacatttataaataattggcttatgactcatatttctctatgaataccttcatacagcaggtataactcttttctttatgggcttaaatattttgtcactgatcctgcaaatggacatcattttagcacactagcggtttatattttaaggaccttcattctctgttctgcacctcttctggaaattgagtaaattttgcttttttttttttactcagttgcaacttacgcttggcatcttcagaatgcttttctagcattaagagatgtaaatgataaaggaattattgtatgaaatattacaaagcgtagactatgcattgttattcattataatattttttgctgtcataatcgcctcataaagacaggtttcaaccattaaaatatgttcttccttaaattcctgtgctttttctagttcctcttgtgtcataaaatgtttatcctaattttctctctgaagtatattttatctgaatccacatttctttataaatccatagtccttgctgaaatatgctttctaaatttctaccactttgttctaggctaattttttaagctaattggatgaagaacaaaaagacatttggtttcatcctttacagcagtaggacaattgcaaaggtttttcctttttcataaggagacacattaataggtaactctgtttcttgagcaggggttcacttattctgagagcattagttctcctaaaaagctccagcatagaaagggaagataaaccaaattctagcttgtgttttacccacagaaggatacaggacaaaggaatagtaactggcctgtttggatactaaaatcgaaaataacttttagcctcctccttatgatagccgccagagtaaatgttgagcattactacagaaaagccacaaaccaagaatctacctgtttggaaagatcttttgcatctctgaaggtgcttaaagcatacttagtgcctttccttttaactgggaagataaaagaagtatctgtccaagatattaatatgtaagataacattgtagacatgttcttctgataatacaaggtttattctatttgcattaggatatttgtggacatgtccatctaatataaaggaaagttttttaatcattgaggcatgtagggctgagttatataatgtagaaacttctaaagataattggatgagaatatacatattgacctgtatattatgactaatcatgactcagatcttaatacagggatgatctcatagcatttagatatcagatcattcctcagtgtttcatttctcaaattctgtaaaaggaatataagaggaaagacaattcatatacaaagacaacgagattaaaaatatgcagtaggaaaaataattacttaaggggagattttttttacatgaaatctgggcttggatgtgtgtgtgtgtgtgtgtgtgtgtgtgtgcacatatgcactgtggtgggagtggggcaacttggggaatatgttacatgtgtgactttgttttgccctggcgaagttaatgttgttcagaaagggtaaatgtttggacacttgcaattgctcatggatgaatttatatgttttagtcatagaaaaattgtaccctttgatagaagcacattttctttccaaagctggttattaaccacagaattatagcaggtattcataacttaagtttgaaaatcaatagcgtctgcaaatggattaacagattagagaatcaacagcatcggaaaataggttaatgcatattgcttctaacaagtgcatgaagaaatagaagaagctatgtagctttcagttctgacagaaaagggtgaaggagggtatcatttcaagaaaaaaaatagctatcacgcaatggttatctctgaaaatatttgtattaagatgtgtatacatggccaggcatggtggctcatgcctgtaatcccagcactttgggaggcaggtggatcacgaggtcaggagatcaagaccatcctggccaacatggtgaaacctcatctctactaaaaatacaaaaatgagcggggtgtggtggcccatgcctgtagtcccagctgctcgggagactgaatctcttgagcctgggaagcagaggttgcagtgaactgagatcgcgtcactgcactccagcctggtgacagagcgagattccatctcaaaaaaaaaaaacagtatgcacgtacaaatttcttaacctgttatcaatgtctgagctacataattatctttctagttggagtttgttttaggtgtgtaccaactgacatttcagtttttctgtttgaagtccaatgtattagtgactctgtggctgctctcttcacctgccccttgtggcctgtctacaattctaaatggattttgaactcaatgtcgtcgcttctggtttcctgcatataccaatagcattacctatgactttttttttcctgagctattttcactgagctgagctaatgaactaaaactgagttatgtttaatatttgtatcaaatacataaaaggaatactgctttttccttttgtggctcaaaggtagctgcattttaaaatatttgtgaaaataaaaacttttgttattagaaaaat

SEQ ID NO: 318387 - DNA, 1136 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggtaagtattctggtaaaatgtgcatg

SEQ ID NO: 318388 - DNA, 2503 bp, Homo sapiens
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagtgagtagacaaacaacaaagttatctattttaaaatactctagaactcatgtaattaatcctatcattagaattattaggttttacttgtttttccatttttatcaaaacgtattcctatatcattattttgaatggaggcatggtcatttggaaagtgacaaaatcataagaatcgactgcattagaagaccactttatttttttcattattttttgtcgaaacattctctatatttaatttcaattttataacagattacaggaagatgcttaagaaacaagtacaacatttgtttcagtatgtctttaaatgaaagacttttaagtatgtaagcaactatataataaaaggtttccaaacgcagcctgtaagaaatcaggcaaattttactataagcaataaaccattccgagctttccagacagtgtaccagtagctgtaccagtgggcaataacctttaaccaaacaaaaacaaacaaacaaacaaacaaaagcactttgcaatttgttgctgcaaaatggggagaaaaaaagagtatataaacttgatggaatcacaactgtcaatataatttaagggaaaataaagtcgataaggttgatggtgtctattgtttggaaagtcgaattcggctatttgcttggggctctagagaccacaccactgaataaacaaaactctgcagagtctagctatccgccaacagggggtgccgtccaaattcatggcaaataaagggcatttggtgctcaccattcacaacaggcgggcatttatgtggatgaagtacaatttcttcagcaagctcagcaaaaactcttaaggggcaaatatgaactctgcattttaagaaaaatagaaaacggaaacacaaaatcctaaaaagtatatgaaggctctgcattagcacactggcatcaaaccacacatccacagcacatcctaattctatgggaaacaatccttgcttatcggaggtgcatatctaaattcaatagcttaccaatatattcttgggagtaggccaaaaggaaacagaaaacccacattaaaaaaagaagtttcttttcctaaacattttcctgaagctgaaattgaagtggagaggaagtcagttgtcctcgtcgaaatcgtagtcctcctcatcctccccaacctgggacaccggggtcttcaccctggagatgctgtactgagacctgttggagcttgtggccagcatttcatccgcaccattggtcaggtcactggcagagagcctcgtgccgttagacgtggaacctgccgttgtgatgaacacgcctgcaacaattgtctgcgccatttctgtcacgtgtggctccagcgcctttgggaccagacttatggctttttttttttttaagttctgggatacatgtgctgaatgtgcaggattgttacataggtatacatgtgccatggtgctttgctgcacctatcaaaccatcatctaggttttaagccccgtatgccttaatgcattagatatttgagaagaccactttaagtgtatcgttaaataaatagagcttaacttggaatgtcgtcttcttgtggctggcactgaggcaaagaaatgtaatcatctaggaattagacgaattgcattttgagttttggcaggatctggcagtaatt

SEQ ID NO: 318389 - DNA, 932 bp, Homo sapiens
ggggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttggtgaaacaaaaagaaaagcatttgtttatttagaacgggcaaaatgatacgtttcagtgggtgttttctttgtactttgatctttttgtactgatatttaagcttctgttttatgatctctttctaatgatagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaaggtacaagtagtccaaagaatatgccttctcattttgattgattctaacttctctttttttgctttgtatttacctgctttatatttcatggtaactgctaattttgtatctttgacataaaggtaattatgaaccactgcaactctatatgatgcgactttatgtgaaatgttataagtataatgtatatttaacatgactccattgctgtcttaaatataaataccaaattctattaaaagctgtctacaggtatgcatgttagtagaaataattgttttaagttatgtccaaagagcatgttggcatgcttttgagtaggaaataagtgagtatattttgtaaaagcacatttataaaagaagttgcactttagttaatactgaga

SEQ ID NO: 318390 - DNA, 910 bp, Homo sapiens
ggaagaatctggaggtgatgaagaatccggtggtgatctgagttccttctaactgtgtctaacagtcctaatctgttaataggtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaagactggttcatttctcaattatatagctagttatatattatctgatacttaaaaataattgactaggaaatggtttcataagaccaggattgctgcatgtagacatgctggccgtgcattttccaaatccagaaaagtcctgaacaaaaatttgaatataatagtatcaggaaataggggaaaatagtgttcaacatagtagaaccaagtactcagagtggtgtacaagagtttaggcctctatgctttagatattagtgtccatgcactcttaaagatgaatgaatgcctgacctttcctaaaggaaaacctttttttagttatcacaggtaacattggtgttgcctgtgggggagaattttttactttctccctatttttcttcagcccacctcaaggcaatgtaaataaaagcagtatgtgtgttataataacttatttagttgtttactgtgtgccagtaccatgctaaagaaagattctttatctcacatgat

SEQ ID NO: 318391 - DNA, 607 bp, Homo sapiens
atgcaaaagtcaaagagtatatgtgagtttgactatacttattgtcaaaatctataaaattgttgtagcgcaacagttttaatcatctttatttttgtattttccttttcaaaaagtaaatgaaattctaggattttagtagttatgttttagtttaaacaatgacacatggattctaactgaatatatatttgaccaggaattatctgagatcttatattttgttgctgatttttgattttttaaaaaccatttcaagtaactcacaaatctaactaactaaaaccttgacattcgattgggcaaataaattgtgtgtatctatatggatgcatgtgtatataactataactatatatgcagttttaaaagtttcaattagtcctgtttaaccttaagttactaccttctcttctgctgtaagaaaaataagttttgaatagtataaaataatgtttttaaaagttggtaattatttagttgttctctttttagataactggattcactttacaatttgcaaaacggctgcaggtcaacctattggtcaagccatcagaaaaaattcagtgagtctcttgaaaatggttattttgatatgatctgt

SEQ ID NO: 318392 - DNA, 1256 bp, Homo sapiens
  misc_feature (1201)..(1201): n is a, c, g, or t
  misc_feature (1218)..(1218): n is a, c, g, or t
  misc_feature (1235)..(1235): n is a, c, g, or t
aattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggggggtaaaaaagggaatcctgtccctaatttggggaaaaggtccactggcggaacattggatttaaaatggggtaacaagaattggccangccctcaattttccaanccttttttggttggaangaaaaaaaggcccaagggtta

SEQ ID NO: 318393 - DNA, 978 bp, Homo sapiens
  misc_feature (914)..(914): n is a, c, g, or t
  misc_feature (963)..(963): n is a, c, g, or t
  misc_feature (970)..(970): n is a, c, g, or t
ggggatgcaactaagttgctgagacaagggaagagagatgagggtgagagttctccttagataagatttcaatatgttaatcatgtgtagaaagaaaattaaaaaggaggaatatgaagaaattcagatatgacattattagttctgccactggtaggcattagaagcaagaaaagggagacggaccgaggaagccactttgaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacacatactgcanatggagttataagtttcatggaaagatacttagtaagtgcatatcgccntttaagnaaaggatt

SEQ ID NO: 318394 - DNA, 652 bp, Homo sapiens
agccattagagcagaaattctctcctgccctgtacttccttccccacttcctacctttgatagttggaatactggcaggcatctcaccaccaagagaagacaaactaaaggatcaaaagcaacgtactgaagataggagagcaaaagatgaaaataacttggatcgttagtgatcctgaagggccaccaaataaacctttggatgcttacctctatacttcctattgacaaaacacttctctacttcaagttttatcacggaccaggactgatcaactaaatgcgaatagatgtgttctatatcagcttccctagaacacaaagcctgaatcaaggatgaaaggaagatgctttttggcaaggcataaattcagaggatccaggatgaggacaaaggcaagtgagctatgcaagatgtaaaatgatgtttcaacaacacaaagctgattgtttggcagttgcatctatttcatgcatagaacttctccagatggactaccaagaaacactgtgcttcaaagaatttgataaggactatgaaaggataacagagctgtgatggaactcgagatctaagtgattctaagtgaccccccaacacacaatgaagcctctgcaaagaaaagcttaaattaaaatagaacacaaactc

SEQ ID NO: 318395 - DNA, 339 bp, Homo sapiens
cctcagagaaatgccaagttcatttaaaataataaacaaatctgtgtgtgtgaagacacccagaggacccacacaggaactgcaatcaagacttctgtgtgtgtgggtggtggaggtggggttcatcttcagatagacgacactaccaggaacctgtcaggagctgacagcaaagcttgattcctgtaaaaaagctccaaggtcatgaacagcccacatgcttccctcctgtccattacacctcggggtcttctgccagcttcctcagtgtgttcaacaacactgggcctgactccaacttctgcagacagtggcacagcactgcccctgaaaggcact

SEQ ID NO: 318396 - DNA, 598 bp, Homo sapiens
taaatggactggctacgtagtatcagaaaaaggcaaacagtttccccagatgagatgacggactgacttgcctgcggtctcgaaaagccaagagactcagcagcaactcccaggagggaaatttccaccactgtccatgtgagatcagtaacgggggacaaagggaggtgggaaaaggctggagccggtagggtggtcagcccatcagagcaggtctatcaacatcgggggaaaaggttacaatgcctgggggcaggaggaggggggtggccgcttccaactcctgtcactgacatttttgtctccaggcattgaggaagggcttgtcttaaactggctgagagtcctatttgtaaggcagccttaattggagacattcagaaaaggaggaaagcgtaccatttctataaacgttaagtcccgtccacgattttcctctggaggattagaaaagcattcttcatgctgcactggagggaggttttcagtctgtgttctggagtcctcgtttaaaaagcgtatgtttggagcccgcattttaaaaccatatctacgaactatctcagaggaggaccccggatttgctccgtcagcatct

SEQ ID NO: 318397 - DNA, 1057 bp, Homo sapiens
gtactgaagcctggccaccccagacttcatcccgtccttccacctactagttggaagcgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacataacagttcagcaagcaagtgttccttctcttgagctgcgtccctcaggaagctgtacctttagggtgtgctttccactttttatttcctctcatttcactcctttcgttgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccacca

SEQ ID NO: 318398 - DNA, 570 bp, Homo sapiens
ggggcatatgttctctttggtgccacacaaaacctgtagtacatgatacagtgttgcttcccccctccttttccttccatatatatttgttttgttttgggcattgcattacttttttgaatttttaagaatctctaacattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgttagagatacacattagggaggccaagctgctttacgcattttgccagactaacgtttgaccaaagatctgagcacgtatggcccagtcaagttgacacataatgttaatcatcacaaaagtcttgcctcatagttgggaaaaattaatcctagaataaatgctattctggtcttgcttagcaaaggttaagagcagaccaaaagatcaacctttccaacaaagctgaagataatgttagagatacggtaccgag

SEQ ID NO: 318399 - DNA, 2641 bp, Homo sapiens
ggggcatatgttctctttggtgccacacaaaacctgtagtacatgatacagtgttgcttcccccctccttttccttccatatatatttgttttgttttgggcattgcattacttttttgaatttttaagaatctctaacattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattggccgggcgtgttggcgggcgcctgtggtcccagctgcttgggaggctgaggcaggagaatcacctgaacccaggaggcggaggttgcagtgagcagagattgcgccactgcactccagcctgggcgacagagcgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacataacagttcagcaagcaagtgttccttctcttgagctgcgtccctcaggaagctgtacctttagggtgtgctttccactttttatttcctctcatttcactcctttcgttgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccacca

SEQ ID NO: 318400 - DNA, 2238 bp, Homo sapiens
ggggcatatgttctctttggtgccacacaaaacctgtagtacatgatacagtgttgcttcccccctccttttccttccatatatatttgttttgttttgggcattgcattacttttttgaatttttaagaatctctaacattagtctgaaggatgttctgagggccagacattagaatttgtgagtttttttgttgctggttgtactttcctatttagaagacagaccgttctgacagttgttgtgtagcttcatgccttccccagtaactaacccatgaacagtacaccccttttatctgacttgttgataatgaccttaaaaatgttaggaaatgggccgggcgcggtggctcgtgcctgtaatccagcactttgggaggccgaggcgagcggatcatgaggtcaagagatcgagaccatcctggtcaacatggtgaaaccccgactctactaaaaaaaatacaaaaattggccgggcgtgttggcgggcgcctgtggtcccagctgcttgggaggctgaggcaggagaatcacctgaacccaggaggcggaggttgcagtgagcagagattgcgccactgcactccagcctgggcgacagagcgagactccgtctcaaaaaaaaaaaaaaaaaaaaaaggttgggaaatattggtgtataatccccatgtctaacaaggaagaagtcaaaagcaaaagatagtggtattgccgaaaactcattatttctagttagttcatctgtggaaaaggatatcgttcttgaggagaggggttctattatgctatagttttctatggaaatgtacaaatgctttcctcattgctctggatgactatttagtttaaataatatacctttgtcatggggaagaccatgattgtggcttcttctaccccaactttgaatgagagagcactgtaagcagaaactgccatcagtctcctgggcaggacctggaggtaactttctgagctgtaaaatagtaattcctaagagagcttacaaactgcttccacacagaaaatagcgcagggaggacagttattagtacccctattctagaagagaaagctgaggctcaagccattaagtgacttgccaaaagctgtgacatagctgggaagtggcagatttggggatataaccaggtcttgcaagtccagtgctgtctccaagtagccacgctcacagctgagaacaccttagaggacaatatcgacttcttacagactaccaagcccccagtcatccagggaaattcagagaccaattgactgccaggtggcaaatccacatgtgtactgcggtctttagagatcatttagagcttgcacacatctgtgtcttcttgtgggaaacctctaggtattctgtctgatcagcactgtgaggaagttggtgggaaaaggccactgataagaacaaacaatgggcagaaggaagcacattgcaataaatttccccagagagagttcctttacattccattcaccaaaaacctctctggaactgtcaggttcagaatatcaaccaagaccatatcatttagaattcattggcatgtagaggtgactcgattcctaaaagaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacataacagttcagcaagcaagtgttccttctcttgagctgcgtccctcaggaagctgtacctttagggtgtgctttccactttttatttcctctcatttcactcctttcgttgtttgctatatcctaaaatatgtgaagtgagagaaaaaatatcatttcttctcattaaatctcctgcattaaatctaagaatcctttaaaataatcacacctgataagtgttttatgcatttccctcccattcctaacctgaattcaggattaaagttaatgattatgaaataaaaactaaataac

SEQ ID NO: 318401 - DNA, 4875 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318402 - DNA, 588 bp, Homo sapiens
cgatgttgactatgatgggaagagggatcggtggaatggctacaatccagaagaacacatgaaaatgttgaagagtatgccaaagttgatttggcaaaacgaacattgaaagcccagaaactccaagaggaattagccttaggaaaattagtggaacaggctaattctccaaaacaccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaaggtgggccccccccgtctccgtgtacagggcacctgcagggagggcagacagctagcctgaaggctgatccccctatctgttagcacttttgatgctgg

SEQ ID NO: 318403 - DNA, 761 bp, Homo sapiens
tcataggttcgcaggaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgc

SEQ ID NO: 318404 - DNA, 6775 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacaacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccagacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgc

SEQ ID NO: 318405 - DNA, 4268 bp, Homo sapiens
ggggagataggtaggagtagcgtggtaagggcgatgagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318406 - DNA, 4845 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgc

SEQ ID NO: 318407 - DNA, 4337 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaaggtagcccagctctccc

SEQ ID NO: 318408 - DNA, 1780 bp, Homo sapiens
ccaagatgattagaggcgcacccggtgttatgcactcagggacgggcctcaagttaaagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318409 - DNA, 3904 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaaagaagccatacggtgaaccaggtgatgctgaggttatctggatccaggccatgcagatgaagccatatttacctttgtgatattggggctgatcttggagctgtctggatctgaccagtctccaggttgaaaactcttgcaactttcgtttttggatagtgctcacctcgtatctgtactcgtaactgctatttctaggcgaattgtcccctttctcctccctcttccctcatctccctctctcctctgcctggctgacaccaggaaggaggagttttcttttatttagataaaaaaaagttgagaggaggcagctccagaaatgtgggatactcagcactggagacatttgggctggaattc

SEQ ID NO: 318410 - DNA, 1570 bp, Homo sapiens
caaggaagccggcgctgctctgaagggagagtctgtgcagtggcacctgcgcgaagctggccaaagcctgcccagacggctcacctgtgcgggatggaacaaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318411 - DNA, 3988 bp, Homo sapiens
  misc_feature (273)..(273): n is a, c, g, or t
  misc_feature (3975)..(3975): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaagaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtccccnaactacgacaagt

SEQ ID NO: 318412 - DNA, 1346 bp, Homo sapiens
ggccgtggaggctggaagctctcgtttagccccaccagcttcccagagcagcaaggccaagcatgcaagagtcaccatccaccctggccatgatgcagggcctcctttgctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318413 - DNA, 831 bp, Homo sapiens
tcataggttcgcaggaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318414 - DNA, 3454 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagaggtgagtgtggcaggggatggcttgggtccacccatcctgctgagctgggggcatgcagggcccctcgatctgaggtctggagcccttcctggtcctcagcagaccttgccttctgggattggtgagattggccgcacactcagtcctgtgtggaaggtgtctgggtgcagtctcaggggtgaccctgcaagcaccatgccctccaggtggcagccatcaccatgcctcactcagccacctctttccttttctgtcattgtgggttgtgtccagggacccctttttttttatcccccacagtcttgccagctcaggctccccagccaaggagacttgtgcaaaggaggtgagtaggaggatggcattttgtctgcctggaatcctcctacttccccctgagtgctttcattaaaaaacagttaacatcgggtttaaggattagaaagtggggttcgtggtttgtgtctgtgacgtgagactggttgaagcacttcacgtcttcctccgggaagactctccttccccttcccccccgtcactgatgtactctgtgtgcggctgcagattgggtaccgagctcg

SEQ ID NO: 318415 - DNA, 2898 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaagtgagttctgcatgctgaggtcagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgc

SEQ ID NO: 318416 - DNA, 473 bp, Homo sapiens
gtacgtgtccgtgggactctcctggtgcccacttcccccagaaggatagggtggcctctgttcatttcaaatcagtcagaggtggctgagcctgaggcagcatctgagagggagcctggttggagaagggagggcccccaagagcagaatcaccatgcacgggaatcgtcattcattggctggaatgcagttgccagccaggccctgagcatccctcctcaaacaaaggtctcatggcaccaccaggacaggtggggcctccactcagggacctgggggctgcccatagaaatggagacccctgatttgtctttaggtaccccagaaaggtttagaccttaaaagcaatgacacacccaaaaaggcccgggtataaatggtaaaatgttaatatttgagattcttggctttttcttacattattctgtctttcctacttaatttttaattgttactaagaaagagaaagccag

SEQ ID NO: 318417 - DNA, 4737 bp, Homo sapiens
ggggagataggtaggagtagcgtggtaagggcgatgagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318418 - DNA, 4544 bp, Homo sapiens
cggtgctgcctgggccccgtcaatcgaagggtcatgtggcggcagcagtcagagaatccaggtgaggcgggccccaggtgagcagtggggagtggagtttggctgcagcagaagccaggtggccatgctgtgggctctgacgccccctcaggtcagagcctccttctccttccctgactgtgtcaggcagctgcccttgggttgcatgcagaagcgtggagggaggcctggcccagcctgctccgcaccaaactctgtttcgtggtctggcaagagtaagggtggccctggtgttgccagatgacccccctccccgggattctcagtgactgtgagtgtgtggcttagtatgtgcggagggtcccctgcctccctttaattccatgtggagcctttgtgggggcaggggtttgtccagaggtcaacaagctggccctcctctctcagagggccctgatggaagaatccccctaccacccttccaggctgacttctgtctatttctcctgcagagtgagctggacttggaaaagggcttggagatgagaaaatgggtcctgtcgggaatcctggctagcgaggagacttacctgagccacctggaggcactgctgctggtgaggaggatttagggagctgagcagggcgggatggggcagggtgacagggttggggagcctctttgcccttaagtcccaggtcagctgtcagagcctgggtgcagctcgccatccctggagtggataccagtggaagactgagttgccaaaccaagctggttttaaaattgtatttgttatgtgatttaaaaataaaagtgcatatgtcaggtaaccatgactgtctactgccatacaatgcacctgacggatggcagcccctctcacctgtgctacctcacttgtgccctcttccagcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggtgagtaacccagggccggtgctgggactacaggcgtgtaccaccacgtccagctaattttttgcatttttagtagagacagggttttgctatgttggccaggctggtctcaaactcctaacctcaagtgatccacctgcctcagcctcccaaagtactgagattacaggcgtgagccgccatgcccagcctttttttttttttttctaatttatatttatttagatagttatttttaaaaagagatggggacttactacgttgtccaggctggagtgcagtggctattcacaggcgcaattccactgctcatcagcacgggagttttgacctccttcctttccaaccttggctgtttcactccttcttaggcaaactgatggttcccgactcctgggaggtcaccatattgatgccaaacttagtgtgtagtgcactacagcccagaactcctgactgaagccatcctccggcctcagccttccgcgtagctggggctataggtgcacgccaccacaccctgtgtgtggctgggactacaggtgcacgccatcacaccctgtgtgcgccatcacaccctgtgtgcaccatcacaccctgtgtgcacacactttccctaaagcaggcttcctccgctgggaaacaagtcctctaggggcaggtgtggccagaggccaggcccccctctaagtgtgaagagcatgtgattccttaaaagcccttcccccagcacttctggactaccgagacacacagctctggcctcgggcctccccttggctggtgctgggggctgagttttctgctctgaggtgtggctttcctgtagggggacccctccctctgccaccctgtgctgcagacccccagactccaggccagagctaaggcttgaggaacacagaaggcacttaatttgttccagttcttgctccctggggctctttcccccatggccagagagcaggaggctgtattttgatacatgctgccccctccatctttgaagcccccccacccccgtttctccgtgtgtgtgtcagcagttttaaacctagtggagggtggtggctcgggctgggctccgcgtcgggctgccccgcagctgctcttgggcagccagggccgctgggtgtggggccgccgggaatggcgggcccgggtgagggcgggggcggagaggcgaagaagctgcaggaagggagggtgacgagggggaagcgaaggaaggggaagaggaagggaaaagcgagcgagaggggcaaggcggaagaggaagcagggcggaagggaagcccgggccgcagacggcgaaggaggcagcgggccgggggctgaggcgggagcgaggacacgcccaagagaggaagcagagggaggcggaagcgtggaggaaggggcgagaggcatcatcaaaggagatgaggggagcgtaggggccgggaaagaggcacaaggaagaaagtatgggaaggaggaatggagggtcagggctaggcggcgggagggcgccaggccgggaagagtacaaggacaaggaggtcaggtttgggcctacatcccggggacaggggcggccatggcggcggcagccagggaggaggaggaggaggcggctcgggagtcagccgcctgcccggctgcggggccagcgctctggcgcctgccggaagtgctgctgctgcacatgtgctcctacctcgacatgcgggccctcggccgcctggcccaggtgtaccgctggctgtggcacttcaccaactgcgacctgctccggcgccagatagcctgggcctcgctcaactccggcttcacgcggctcggcaccaacctgatgaccagtgtcccagtgaaggtgtctcagaactggatagtggggtgctgccgagaggggattctgctgaagtggagatgcagtcagatgccctggatgcagctagaggatgatgctttgtacatatcccaggctaatttcatcctggcctaccagttccgtccagatggtgccagcttgaaccgtcagcctctgggagtctgctgggcatgatgaggacgtttgccactttgtgctggccacctcgcatattgtcagtgcaggaggagatgggaagattggccttggtaagattcacagcaccttcgctgccaagtactgggctcatgaacaggaggtgaactgtgtggattgcaaagggggcatcatatcattgtgagtggctccagggacaggacggccaaggtgtggcctttggcctcaggccagctggggtagtgtttatacaccatccagactgaagaccaaatctggtctgttgctatcaggccattactcagctcttttgtgacagggacggcttgttgtgggcacttctcacccctgaaaatctgggacctcaacagtgggcagctgatgacacacttggacagagactttcccccaagggctggggtgctggatgtcatatatgagtcccctttcgcactgctctcctgtggctatgacacctatgttcgctactgggactgccgcaccagtgtccggaaatgtgtcatggagtgggaggagccccacaacagcaccctgtactgcctgcagacagatggcaaccacttgcttgccacaggttcctccttctatagcgttgtacggctgtgggaccggcaccaaagggcctgcccgcacaccttcccgctgacgtcgacccgcctcggcagccctgtgtactgcctgcatctcaccaccaagcatctctatgctgcgctgtcttacaacctccacgtcctggatattcaaaacccgtgaccgtcagggccacccctgcctgtgggccaaggagaccagtgagtcagggacctctcttgcatgaagggtgcagtgatagttcctccccactgccccactgtgctcctgggcctgtgaccccagtgctcaggcaccttgcagtagaggcttctgactcctggagctttgtggcttaccagagatgcagtccctcccaggaacctgttggagaggcaggacctgctgctttagaggagtgcagctgaacctcggccctgcgactctgtttggccagagcaaggatctggcctggagaggcccatcctacaccccttattagagccgtgatagcctacagagtgaggtgaggttctcccgccttcccaggtggtttctttctgccacttcctggaaagaaaggtgaggctgccagtagcccactagcaccagccagacctcacgcttgaccaacctctcggggccagaggttcattcctggggcactgtggcctggttttgttttgaaaccaagagagggcaaagggaacccagcagttctgagtgagttctagccagccctacctcaggctggctgttgagagattttacaattttcatttttgtaaaaataaagcttgattgttcccagaaaaaaaaag

SEQ ID NO: 318419 - DNA, 7096 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacactccacttctaacagggtttgagaggcttagtcagcactgggtagcgtttgactccattcttggctttcttctttttctttccagaaggattttgtgcagaaatgggtctttgttgccatgttagtcctccttggaaggcagctcagaaggcccgtgaaatgtcgggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggcagcagcttgctgatgacttgttttaaaactttcatcctaaataaccttttgatacttgaatatttgtaagttttatacatagtttctaatttttttccgaacagatccagatacctaataagatgctggaatgtaatccctggacaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggagaccgccaagtattttcaagaaataaccccatgaatattccatcacttttttagaaagaggggcttggggcaggcagaggagagaagggagagcaaactgagagccaagtttccagacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgc

SEQ ID NO: 318420 - DNA, 5089 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcagtgagtgttggcctgcgcaggacgggatggaggtgtgggcaatggtgtccgcgatgagatctcagagtgctccatggcccagataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318421 - DNA, 5307 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctggtgaggaggatttagggagctgagcagggcgggatggggcagggtgacagggttggggagcctctttgcccttaagtcccaggtcagctgtcagagcctgggtgcagctcgccatccctggagtggataccagtggaagactgagttgccaaaccaagctggttttaaaattgtatttgttatgtgatttaaaaataaaagtgcatatgtcaggtaaccatgactgtctactgccatacaatgcacctgacggatggcagcccctctcacctgtgctacctcacttgtgccctcttccagcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaatctgtactgcaccctggaggtggattcctttgggtattttgtgaataaagcaaagacgcgcgtctacagggacacagctgagccaaactggaacgaggaatttgagatagagctggagggctcccagaccctgaggatactgtgctatgaaaagtgttacaacaagacgaagatccccaaggaggacggcgagagcacggacagactcatggggaagggccaggtccagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318422 - DNA, 4164 bp, Homo sapiens
  misc_feature (273)..(273): n is a, c, g, or t
  misc_feature (4151)..(4151): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaaaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtccccnaactacgacaagt

SEQ ID NO: 318423 - DNA, 4089 bp, Homo sapiens
  misc_feature (273)..(273): n is a, c, g, or t
  misc_feature (4076)..(4076): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtccccnaactacgacaagt

SEQ ID NO: 318424 - DNA, 4657 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagcaccggcagctgctgaaggacagcttcatggtggagctggtggagggggcccgcaagctgcgccacgtcttcctgttcaccgacctgcttctctgcaccaagctcaagaagcagagcggaggcaaaacgcagcagtatgactgcaaatggtacattccgctcacggatctcagcttccagatggtggatgaactggaggcagtgcccaacatccccctggtgcccgatgaggagctggacgctttgaagatcaagatctcccagatcaagagtgacatccagagagagaagagggcgaacaagggcagcaaggctacggagaggctgaagaagaagctgtcggagcaggagtcactgctgctgcttatgtctcccagcatggccttcagggtgcacagccgcaacggcaagagttacacgttcctgatctcctctgactatgagcgtgcagagtggagggagaacatccgggagcagcagaagaagtgtttcagaagcttctccctgacatccgtggagctgcagatgctgaccaactcgtgtgtgaaactccagactgtccacagcattccgctgaccatcaataaggaagatgatgagtctccggggctctatgggtttctgaatgtcatcgtccactcagccactggatttaagcagagttcaagcagaggagagaagggagagcaaactgagagccaagtttccagacggtcctgcaggaggagaggatgcagctgcccagagggaagcaggatcacatttaaggaagtgtgtggggtccctggatgacaccagcacccagtgcggctctgtctggcacccgctcccaaggtgggaggagtgggtgtcccctgtgtgtcagtgggcagctcctgctgaacccgcagctcactagggagcctgacagtggggccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggcgaggacagaacaggagcctctgctctctgtacctatctgggcccggtgggctcccttgtcctggcttccatctctgtctcagcgaccattcagccctgcgcaggaacacgtgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcccgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcagtgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgc

SEQ ID NO: 318425 - DNA, 1530 bp, Homo sapiens
agagccagtgcctggaggccaacaccctggtcttcagtcactgggagtcacagagaggggcccgataaagagccctcctggcagcatcagtaccagatgctgcttctcagggtggggtccctgaggcctggagtgtggcctctgacgaccttcagggccaggtgcggaatgagagcctgtggccgcatggcccccggtgggagacgtcctgccgccctttgcttctctgtaccactctggctgcacagttcagagccttgggaaacgttaaccagtaggacctagaaggggagctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcaataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318426 - DNA, 1428 bp, Homo sapiens
ggccgtggaggctggaagctctcgtttagccccaccagcttcccagagcagcaaggccaagcatgcaagagtcaccatccaccctggccatgatgcagggcctcctttgctggacccgcaggccctgcaggacagagactggcagcgcaccgtcatcgccatgaatgggatcgaagtaaagctctcggtcaagttcaacagcagggagttcagcttgaagaggatgccgtcccgaaaacagacaggggtcttcggagtcaagattgctgtggtcaccaagagagagaggtccaaggtgccctacatcgtgcgccagtgcgtggaggagatcgagcgccgaggcatggaggaggtgggcatctaccgcgtgtccggtgtggccacggacatccaggcactgaaggcagccttcgacgtcagtgagtgttggcctgcgcaggacgggatggaggtgtgggcaatggtgtccgcgatgagatctcagagtgctccatggcccagataacaaggacgtgtcggtgatgatgagcgagatggacgtgaacgccatcgcaggcacgctgaagctgtacttccgtgagctgcccgagcccctcttcactgacgagttctaccccaacttcgcagagggcatcgctctttcagacccggttgcaaaggagagctgcatgctcaacctgctgctgtccctgccggaggccaacctgctcaccttccttttccttctggaccacctgaaaagggtggcagagaaggaggcagtcaataagatgtccctgcacaacctcgccacggtctttggccccacgctgctccggccctccgagaaggagagcaagctccctgccaaccccagccagcctatcaccatgactgacagctggtccttggaggtcatgtcccaggtccaggtgctgctgtacttcctgcagctggaggccatccctgccccggacagcaagagacagagcatcctgttctccaccgaagtctaaaggtcccagtccatctcctggaggcagacagatggcctggaaacctctggctaatcgggccatccgtagagcgggaaccttcctgaggtgtccttgggccacccccaagtgttgggccatctgccaagagacagcgacccaaagccgaaggacaggtggcctggaaagatcccgcccaggtctgggagccccaggctggcctcagactgtggttttttatgtggccacctgagggcgccccaagccagttcatctcagagtccaggcctgaccctgggagacagggtgaagggagtggtttttatgaacttaacttagagtctaaaagatttctactggatcacttgtcaagatgcgccctctctggggagaagggaacgtgactggattccctcactgttgtatcttgaataaacgctgctgcttcatcctg

SEQ ID NO: 318427 - DNA, 3552 bp, Homo sapiens
  misc_feature (273)..(273): n is a, c, g, or t
  misc_feature (3539)..(3539): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagccacctggaggcactgctgctgcccatgaagcctttgaaagccgctgccaccacctctcagccggtgctgacgagtcagcagatcgagaccatcttcttcaaagtgcctgagctctacgagatccacaaggagttctatgatgggctcttcccccgcgtgcagcagtggagccaccagcagcgggtgggcgacctcttccagaagctggccagccagctgggtgtgtaccgggccttcgtggacaactacggagttgccatggaaatggctgagaagtgctgtcaggccaatgctcagtttgcagaaatctccgagaacctgagagccagaagcaacaaagatgccaaggatccaacgaccaagaactctctggaaactctgctctacaagcctgtggaccgtgtgacgaggagcacgctggtcctccatgacttgctgaagcacactcctgccagccaccctgaccaccccttgctgcaggacgccctccgcatctcacagaacttcctgtccagcatcaatgaggagatcacaccccgacggcagtccatgacggtgaagaagggagagggagaagacaggatgaaagcttcatcaacgaggaagagattactccttatggaagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtccccnaactacgacaagt

SEQ ID NO: 318428 - DNA, 2329 bp, Homo sapiens
  misc_feature (273)..(273): n is a, c, g, or t
ttccaggactgcagaactggcccagacctctgtattggaaaggtctttatggaccagggagtccggtgtcttttttacggggacccctgggctgcgagttgcacagtccaattcgctgttgttagggcctcagtttcccaaaaggcacagggacggggggagggtggcggctcgatgggggagccgcctccagggggcccccccgccctgtgcccacggcgcggcccctttaaggaggcccgcctggctccgctccatcgcgcatcgcggccncctccccccggccctccccttcctgcggcgcagagtgcgggccgggcgggagtgcggcgagagccggctggctgagcttagcgtccgaggaggcggcggcggcggcggcggcagcggcggcggcggggctgtggggcggtgcggaagcgagaggcgaggagcgcgcgggccgtggccagagtctggcggcggcctggcggagcggagagcagcgcccgcgcctcgccgtgcggaggagccccgcacacaatagcggcgcgcgcagcccgcgcccttccccccggcgcgccccgccccgcgcgccgagcgccccgctccgcctcacctgccaccagggagtgggcgggcattgttcgccgccgccgccgccgcgcggggccatgggggccgcccggcgcccggggccgggcctggcgaggccgccgcgccgccgctgagacgggccccgcgcgcagcccggcggcgcaggtaaggccggccgcgccatggtggacccggtgggcttcgcggaggcgtggaaggcgcagttcccggactcagagcccccgcgcatggagctgcgctcagtgggcgacatcgagcaggagctggagcgctgcaaggcctccattcggcgcctggagcaggaggtgaaccaggagcgcttccgcatgatctacctgcagacgttgctggccaaggaaaagaagagctatgaccggcagcgatggggcttccggcgcgcggcgcaggcccccgacggcgcctccgagccccgagcgtccgcgtcgcgcccgcagccagcgcccgccgacggagccgacccgccgcccgccgaggagcccgaggcccggcccgacggcgagggttctccgggtaaggccaggcccgggaccgcccgcaggcccggggcagccgcgtcgggggaacgggacgaccggggaccccccgccagcgtggcggcgctcaggtccaacttcgagcggatccgcaagggccatggccagcccggggcggacgccgagaagcccttctacgtgaacgtcgagtttcaccacgagcgcggcctggtgaaggtcaacgacaaagaggtgtcggaccgcatcagctccctgggcagccaggccatgcagatggagcgcaaaaagtcccagcacggcgcgggctcgagcgtgggggatgcatccaggcccccttaccggggacgctcctcggagagcagctgcggcgtcgacggcgactacgaggacgccgagttgaacccccgcttcctgaaggacaacctgatcgacgccaatggcggtagcaggcccccttggccgcccctggagtaccagccctaccagagcatctacgtcgggggcatgatggaaggggagggcaagggcccgctcctgcgcagccagagcacctctgagcaggagaagcgccttacctggccccgcaggtcctactccccccggagttttgaggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcagatggctcgttcggaacaccacctggatacggctgcgctgcagaccgggcagaggagcagcgccggcaccaagatgggctgccctacattgatgactcgccctcctcatcgccccacctcagcagcaagggcaggggcagccgggatgcgctggtctcgggagccctggagtccactaaagcgagtgagctggacttggaaaagggcttggagatgagaaaatgggtcctgtcgggaatcctggctagcgaggagacttacctgagcccctaggggtcctctagatcacccac

SEQ ID NO: 318429 - DNA, 368 bp, Homo sapiens
ggattgcggaggcggctataccccggactgcagctccaatgagaacctcacctccagcgaggaggacttctcctctggccagtccagccgcgtgtccccaagccccaccacctaccgcatgttccgggacaaaagccgctctccctcgcagaactcgcaacagtccttcgacagcagcagtccccccacgccgcagtgccataagcggcaccggcactgcccggttgtcgtgtccgaggccaccatcgtgggcgtccgcaagaccgggcagatctggcccaacgatggcgagggcgccttccatggagacgcaggtgagttcctcacgccacgtgcgtgggcacacctgcacgggggaggaaaaccat

SEQ ID NO: 318430 - DNA, 4518 bp, Homo sapiens
cccggaggcagcggctgcgccctgcgccggggcggagccgggggcgggccggcggccggcaggcgggggctggggcccgaggccgggagtgcctgagcgccggcggcgacgacggcagcggcggcccagcgggctcggtggttgggtccgcggcggctcggggtccgcccgcgggctgcggtgcgagcgggcggcccggctcccctcctcccccgcccgccgccgccgctgtgattgggtggaagatggcgctggccggatggaaatcctaatgacagtctccaaattcgcctccatctgtaccatgggcgccaatgcttcggcattagagaaagagattggtccagaacagtttccggtcaatgagcactattttggattagtcaattttgggaatacctgctactgcaattcagttcttcaagcactttatttttgtcgtccatttcgggaaaaagttcttgcgtataagagtcaacctaggaaaaaggagagccttcttacatgcttagcagatctcttccatagcatagccactcagaagaaaaaggttggagtaataccccctaagaagttcatcacaagattacggaaagaaaatgagctttttgacaactacatgcaacaagatgcccatgaattcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaagtggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaagcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaaggggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacggatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtgcctgtgggtttcaagtgtg

SEQ ID NO: 318431 - DNA, 1069 bp, Homo sapiens
  misc_feature (1)..(3): n is a, c, g, or t
  misc_feature (48)..(48): n is a, c, g, or t
  misc_feature (55)..(55): n is a, c, g, or t
nnnggaatgactatggcactgtggcacaataatcttgcacggatctgnggaatancatttcaaggttcagtggaggagaaccccaagagcaccaaaatggaaagatgatttgtaaagctgaggaaaatgtccagctgtgtttttatgaggactctcactgcactgatatgacagatgacaccttccctcaacactgttcatcattgactgctgagggctccttcttcagtttataacaggatggtaacttcataagcaatgtaggactttcacagggttccacacgaagcgtgtctggataattcagccaagctcttcagtctccagcagtgatggaatcaggagctcgcttggccagccctctaatgactcagtcacagggtcatccacttgggggtgtgaggagaggaggcttctccccgcaagtgctttcggggtgatgccgtagattctttgtacctcaggagttacttttgcaattagaggttctctctctctcttggtattttatgcatctaattctgcttttctatgcatgagtcttgtcggattcaggcacagcaataagtctccaaaatagggtcagagtgagtttaatgaagaagttattgttttcttaaggatgaaaataaacagagagaatgccttattacataatcaataacgtcggcctcttgattaaaacacaaatgcaatttagcccgaaattattctctagtttgatgttctacaaaattagattacgataataaatgattggacctcttaagcacaggcaggtgtccacacgctgatagcctctggaggagcaggcttcccaatccggatttcctacggatgaaagtttaggaagatgtagtactgatcccaacatctcactcatagtttctgcaattattaaaggctaaaagacaacacacataatggaaaagcttagacttttggaatcggaggctggatttagatactagtttctctgcttaatcagctgtgcaaattttgtttcaagttacttaatctttctgagcctgttttcttaaaataaaacattttgaaatggggtaacaat

SEQ ID NO: 318432 - DNA, 1094 bp, Homo sapiens
  misc_feature (80)..(80): n is a, c, g, or t
tggttaataaaatattaggtggtttgggttcttccgatcttctactcttcacttacacctctcttgtccataaggaatancatttcaaggttcagtggaggagaaccccaagagcaccaaaatggaaagatgatttgtaaagctgaggaaaatgtccagctgtgtttttatgaggactctcactgcactgatatgacagatgacaccttccctcaacactgttcatcattgactgctgagggctccttcttcagtttataacaggatggtaacttcataagcaatgtaggactttcacagggttccacacgaagcgtgtctggataattcagccaagctcttcagtctccagcagtgatggaatcaggagctcgcttggccagccctctaatgactcagtcacagggtcatccacttgggggtgtgaggagaggaggcttctccccgcaagtgctttcggggtgatgccgtagattctttgtacctcaggagttacttttgcaattagaggttctctctctctcttggtattttatgcatctaattctgcttttctatgcatgagtcttgtcggattcaggcacagcaataagtctccaaaatagggtcagagtgagtttaatgaagaagttattgttttcttaaggatgaaaataaacagagagaatgccttattacataatcaataacgtcggcctcttgattaaaacacaaatgcaatttagcccgaaattattctctagtttgatgttctacaaaattagattacgataataaatgattggacctcttaagcacaggcaggtgtccacacgctgatagcctctggaggagcaggcttcccaatccggatttcctacggatgaaagtttaggaagatgtagtactgatcccaacatctcactcatagtttctgcaattattaaaggctaaaagacaacacacataatggaaaagcttagacttttggaatcggaggctggatttagatactagtttctctgcttaatcagctgtgcaaattttgtttcaagttacttaatctttctgagcctgttttcttaaaataaaacattttgaaatggggtaacaat

SEQ ID NO: 318433 - DNA, 1071 bp, Homo sapiens
  misc_feature (57)..(57): n is a, c, g, or t
ggccgccgccactcccctttcgatacatattatagtagaaagcctcttcgggaatancatttcaaggttcagtggaggagaaccccaagagcaccaaaatggaaagatgatttgtaaagctgaggaaaatgtccagctgtgtttttatgaggactctcactgcactgatatgacagatgacaccttccctcaacactgttcatcattgactgctgagggctccttcttcagtttataacaggatggtaacttcataagcaatgtaggactttcacagggttccacacgaagcgtgtctggataattcagccaagctcttcagtctccagcagtgatggaatcaggagctcgcttggccagccctctaatgactcagtcacagggtcatccacttgggggtgtgaggagaggaggcttctccccgcaagtgctttcggggtgatgccgtagattctttgtacctcaggagttacttttgcaattagaggttctctctctctcttggtattttatgcatctaattctgcttttctatgcatgagtcttgtcggattcaggcacagcaataagtctccaaaatagggtcagagtgagtttaatgaagaagttattgttttcttaaggatgaaaataaacagagagaatgccttattacataatcaataacgtcggcctcttgattaaaacacaaatgcaatttagcccgaaattattctctagtttgatgttctacaaaattagattacgataataaatgattggacctcttaagcacaggcaggtgtccacacgctgatagcctctggaggagcaggcttcccaatccggatttcctacggatgaaagtttaggaagatgtagtactgatcccaacatctcactcatagtttctgcaattattaaaggctaaaagacaacacacataatggaaaagcttagacttttggaatcggaggctggatttagatactagtttctctgcttaatcagctgtgcaaattttgtttcaagttacttaatctttctgagcctgttttcttaaaataaaacattttgaaatggggtaacaat

SEQ ID NO: 318434 - DNA, 1078 bp, Homo sapiens
  misc_feature (1)..(3): n is a, c, g, or t
  misc_feature (64)..(64): n is a, c, g, or t
nnnttgaaatcagcaagtggcatctgttagcagaaaaatcattggccaggaatctagggaatancatttcaaggttcagtggaggagaaccccaagagcaccaaaatggaaagatgatttgtaaagctgaggaaaatgtccagctgtgtttttatgaggactctcactgcactgatatgacagatgacaccttccctcaacactgttcatcattgactgctgagggctccttcttcagtttataacaggatggtaacttcataagcaatgtaggactttcacagggttccacacgaagcgtgtctggataattcagccaagctcttcagtctccagcagtgatggaatcaggagctcgcttggccagccctctaatgactcagtcacagggtcatccacttgggggtgtgaggagaggaggcttctccccgcaagtgctttcggggtgatgccgtagattctttgtacctcaggagttacttttgcaattagaggttctctctctctcttggtattttatgcatctaattctgcttttctatgcatgagtcttgtcggattcaggcacagcaataagtctccaaaatagggtcagagtgagtttaatgaagaagttattgttttcttaaggatgaaaataaacagagagaatgccttattacataatcaataacgtcggcctcttgattaaaacacaaatgcaatttagcccgaaattattctctagtttgatgttctacaaaattagattacgataataaatgattggacctcttaagcacaggcaggtgtccacacgctgatagcctctggaggagcaggcttcccaatccggatttcctacggatgaaagtttaggaagatgtagtactgatcccaacatctcactcatagtttctgcaattattaaaggctaaaagacaacacacataatggaaaagcttagacttttggaatcggaggctggatttagatactagtttctctgcttaatcagctgtgcaaattttgtttcaagttacttaatctttctgagcctgttttcttaaaataaaacattttgaaatggggtaacaat

SEQ ID NO: 318435 - DNA, 4495 bp, Homo sapiens
agcggaaggggaaatgtcaggaaaagtgaagattcagtaacttatttttactatgctgtcaaatttctccagtatcaaattgtattttaaaaaatagttctaatgacaagcagaagatgattccatttttgtttaaaaaagcaatttttttttctgaatgatgtatggtttacaacagtcattaaagcaactatttacaagggcgccaatgcttcggcattagagaaagagattggtccagaacagtttccggtcaatgagcactattttggattagtcaattttgggaatacctgctactgcaattcagttcttcaagcactttatttttgtcgtccatttcgggaaaaagttcttgcgtataagagtcaacctaggaaaaaggagagccttcttacatgcttagcagatctcttccatagcatagccactcagaagaaaaaggttggagtaataccccctaagaagttcatcacaagattacggaaagaaaatgactgtcagttccatgacggagggaacccatttgtttttgctcaccattgtattcccagcacataatccagttcctggcacataagctttttgacaactacatgcaacaagatgcccatgaattcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaagtggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaagcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaaggggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacggatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtgcctgtgggtttcaagtgtg

SEQ ID NO: 318436 - DNA, 3497 bp, Homo sapiens
tggcctcgtgatcggaggcgttgaatgtgccgaggcggtattggcccggaggctgtagaaatggcccgggtagtttttcctttagaacttcgtctgtttaacacttcaggtgatgccaccaatccagacagaatgtacgaccttgttgctgttgtggttcactgtggaagtggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaagcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaaggggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacggatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtgcctgtgggtttcaagtgtg

SEQ ID NO: 318437 - DNA, 2212 bp, Homo sapiens
  misc_feature (1198)..(1198): n is a, c, g, or t
cccggaggcagcggctgcgccctgcgccggggcggagccgggggcgggccggcggccggcaggcgggggctggggcccgaggccgggagtgcctgagcgccggcggcgacgacggcagcggcggcccagcgggctcggtggttgggtccgcggcggctcggggtccgcccgcgggctgcggtgcgagcgggcggcccggctcccctcctcccccgcccgccgccgccgctgtgattgggtggaagatggcgctggccggatggaaatcctaatgacagtctccaaattcgcctccatctgtaccatgggcgccaatgcttcggcattagagaaagagattggtccagaacagtttccggtcaatgagcactattttggattagtcaattttgggaatacctgctactgcaattcagttcttcaagcactttatttttgtcgtccatttcgggaaaaagttcttgcgtataagagtcaacctaggaaaaaggagagccttcttacatgcttagcagatctcttccatagcatagccactcagaagaaaaaggttggagtaataccccctaagaagttcatcacaagattacggaaagaaaatgagctttttgacaactacatgcaacaagatgcccatgaattcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaagggaatancatttcaaggttcagtggaggagaaccccaagagcaccaaaatggaaagatgatttgtaaagctgaggaaaatgtccagctgtgtttttatgaggactctcactgcactgatatgacagatgacaccttccctcaacactgttcatcattgactgctgagggctccttcttcagtttataacaggatggtaacttcataagcaatgtaggactttcacagggttccacacgaagcgtgtctggataattcagccaagctcttcagtctccagcagtgatggaatcaggagctcgcttggccagccctctaatgactcagtcacagggtcatccacttgggggtgtgaggagaggaggcttctccccgcaagtgctttcggggtgatgccgtagattctttgtacctcaggagttacttttgcaattagaggttctctctctctcttggtattttatgcatctaattctgcttttctatgcatgagtcttgtcggattcaggcacagcaataagtctccaaaatagggtcagagtgagtttaatgaagaagttattgttttcttaaggatgaaaataaacagagagaatgccttattacataatcaataacgtcggcctcttgattaaaacacaaatgcaatttagcccgaaattattctctagtttgatgttctacaaaattagattacgataataaatgattggacctcttaagcacaggcaggtgtccacacgctgatagcctctggaggagcaggcttcccaatccggatttcctacggatgaaagtttaggaagatgtagtactgatcccaacatctcactcatagtttctgcaattattaaaggctaaaagacaacacacataatggaaaagcttagacttttggaatcggaggctggatttagatactagtttctctgcttaatcagctgtgcaaattttgtttcaagttacttaatctttctgagcctgttttcttaaaataaaacattttgaaatggggtaacaat

SEQ ID NO: 318438 - DNA, 508 bp, Homo sapiens
ctctgtgcagtgaatacaagtattactgtgaagagtgtcgcagcaaacaggaagcacacaaacggtaattttagagctttatggatttttaagtgattttattttttgtaattgatgttggaggtgggcttagaaaaacaatctaggaaaatttacattgagtaaaaattcttaattctatcactaacagttaatgttcattaagtattactaggtaaatgatattctactcaatgtttattttacaaaaactgtgtaccctgaagtgatttcctatgtctagcgattatttaatcatcataaaccagtacagttaaaatatttggctttgaggctttcctgatgatgtaaacttttttcttggtgaagagggttgagggagatagcactccccattgcccatcccccacacccccagtttctgcttttcctacataggatgttgtacattctcttagcatgttattgtaagactggtttggtatcaataaatggaataataaacatc

SEQ ID NO: 318439 - DNA, 556 bp, Homo sapiens
cccggaggcagcggctgcgccctgcgccggggcggagccgggggcgggccggcggccggcaggcgggggctggggcccgaggccgggagtgcctgagcgccggcggcgacgacggcagcggcggcccagcgggctcggtggttgggtccgcggcggctcggggtccgcccgcgggctgcggtgcgagcgggcggcccggctcccctcctcccccgcccgccgccgccgctgtgattgggtggaagatggcgctggccggatggaaatcctaatgacagtctccaaattcgcctccatctgtaccatggagtggtgaatcagatctgaaagatgccttaaaaagcagattctctactacacgctgaggaacagtacaaaaaatgactgaaatcaggtggacataaaatcgacagtattaaagaaatcatattgaaggatgaatcattgaagactccatttcccaactggatgattgttctttctcacagtttacattttaggaaagcatttgtattaaatggactatattaaaatgattttggagaattgtttgggc

SEQ ID NO: 318440 - DNA, 3903 bp, Homo sapiens
ggacgcgtgggtcgacccacgcgtccgcttaaattacctactaaatacaattgctgatattttacaagaagagagaaagcaggaaaaacaaaatggtcgtttacctaatggtaatattgataatgaaaataataacagcacaccagacccaacgtgggttcatgagatttttcagggaacattaactaatgaaaccagatgtcttacttgtgaaactataagcagcaaagatgaagattttttagacctttctgttgacgtggaacaaaatacatcaattactcactgcttaaggggtttcagcaacacagaaactctgtgcagtgaatacaagtattactgtgaagagtgtcgcagcaaacaggaagcacacaaacggatgaaagttaaaaaactgcccatgattctagctctacacctgaagagatttaaatatatggatcaacttcatcgatatacaaaactctcttaccgggtagtttttcctttagaacttcgtctgtttaacacttcaggtgatgccaccaatccagacagaatgtacgaccttgttgctgttgtggttcactgtggaagtggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaagcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaaggggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacggatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtgcctgtgggtttcaagtgtg

SEQ ID NO: 318441 - DNA, 3353 bp, Homo sapiens
tagaggatcccaaatctctcatgcgctggtcccaatcgaggccattatattgcaatagttaagagtcatgatttttggttgttgtttgatgacgacattgtagaaaaaatagatgcacaagctattgaagaattctacgggttgacatcagatatctcaaagaactctgagtctggttacatccttttctatcagtctcgggactgagagggaaccgtgatgaagagacactttctgcctcatttcttctctggttattttggaaaggatcaagcactgatttttcaagaaaagagaaatgcaggaagctcagggggcagtagcacactttgcacacgataaagcaaagacgatggattgacaagcccttccgatcatggtagttgatttatttgctcaggtatcatgctgtctgtacagttccatacaacaaggaggtgaaatcagagataccagctcctcttttaaaacagccttccagtcattggcacgcattttctctttattaattgcaccaataatgctttgaattccttgggggtgcagtagaaagaatcggaatctgtgccgtattgataaggagatgatgttgaacacactgcataaatttgcctggttcagtatgtatagaagcatattcagtggtcttttcaagagtaaaccagaaatacttttgggcccaacacttgcagttgccttcctgatgtaaaaactaacatgctagataatccagtgtcgggaagacaaagatgttttgcttctctgaagaagcttataataatatacagtatatgtatatgtagggagcaattggtcaaaagtggctttttgtttccccaaggggaaagactggctttgtaattataattttttccttatttattttacttaaaactggtagagtctaagtattatatgaagtgcccatgattctgtcagtaaatttgaacatatttttattagttaatgtcagtttaagttgtccttttgtttgtttctatttttaaggtgaattttaatttctatctgaaatcagttaagataccttgagaaaaactgcagtgagaggagataaatatcctttttcaggaggaactgatatctctggctaaatatttgtccttttattatggtttctaaatcagttattttcttcagctttaatttcataaaattaaaaaactattttaaaaattcctgtagttgttggaataattaaaaattctggtgcagtggtggtataccaatctttagaattcttaagtattctaatgtttcaagttgagatcatgcttgggaaaatcatgtcatagcatttatgttattttcagatgccattttttaccctggaaagaagtcataatgttcatcataaccctagcagcctggatagtgagctaaacaaacccttcaaagattaaattttaatcaagtagaccgggaatacaaaagacaagtccttccttcccttccccccacctttacaaatcttactggaagggtgttcagaaattaaaatctgtgtttgctaagacttcattctgttgggggttttaagaagtaatatatgtaacataaaatatatgtaaacgattgcagtttttttggacgtttttccatgcatcagtaagttgtctgacagtagccaaatgtaacttgcagaaaattattgaaaattatattcagaataatagcaatcaggccttggatgttctttattaaactcttttcaggcagtaaatttaaaaaaaattgtcattttctaaagtccttttgctaaaactgttgactatggaaaacaacaaaaaggaattttttagtctgctgctattattaacatttattatctgtatcttttggctcaggaaatgacttcacctattttttccataagcagacctttaacagagtcacttaattgggctgcttaaacggatgttctgggagaaaattataatatttagtatttgtacaaaatatcaaaaagtattttgacaagtttctttttaagatagttcctaaagccttaccctggctagaggtgttttgtacaaattatatataagccagcctgatctaccaacatgccacagagaatcacaatcaacagtgtggggaaagtcagggcagtggaagtggatgcactctttttattttgaaggcttaaaccaaattgtcttggaattaaagctgtatttctgcagctttcggtacagagaaaaagaggaaagtgaagctgtgtcagttttaacattagctatatcaacatgtttaagaaagatagatgaagtcatttgcataaaggtacagcattgaaatactatgttgtgtttgtttttacatttttgcattaaaaaaaaacatgccgtaaaagccaagttaaatttcatattaaagcaagttctagtgtatgtgttgagttcctggtaatcacatacttgttcacatctacaccgtacttcatagtatgatttgtcaggggagggattgtggggtgacagttttacatttactttttcttcttaatgcagctggatctaagtaaaatgttttgaagtttatcagaaactaaatgtacttttaaaacgtatagggtcagggttgggggaaaaatacaggtatagtaagtaagaaaagtgacccatgaagaaagcatcgtgaggttgtatgttggttgactgtgattaaaatgcggggctggtgtaagttgtaagtggtggctgattgccgtgtaactatgtacatgattgttgggatggctgtcccatattttgtatattggaataaaaatttctataaattattgtaactaaaagtaaatattctaaattaagtcccacttcttaagtcacatggcttctgtcttggaaattttacctttaaaagattatttaagacaggaaccaggaggcttgggaacagggaaagagggaaatgttgtattatgtgggtcttggggcctctaaccatcagtatagggttttttctttccttgatggcagtagaaagacctcattttcataacataactactcttgatactttctttaaaaacactttttattaaagattctatcatgaggtatttggctgggagctgggaggctaaagcgctcatgtcctggctcttcagtgaatttaactgtgtgaccttgggcaagtcacttaacctctctgtgcttcagtctccctgtcttgtaaaatgggagtaatacctacctcacagggttgttgtggggattaattagagataatgtctgtaaagcatttaaggttcttgaagaaggcactatataaatacaaaataatatctattaaagttggtttatttgtgcctgtgggtttcaagtgtg

SEQ ID NO: 318442 - DNA, 1874 bp, Homo sapiens
aaacttcatactggtgagaaaccctatgaatgtaaggaatgcgggaaggcctttagagtgcgacaacaactaacactccatcagagaattcatactggtgagaaaccctatgaatgtaaggaatgtggaaagacctttagccgtggttatcatcttattctccatcacagaattcatactggtgaaaaaccttacgaatgtaaggaatgctggaaagcctttagtcgctactcacaacttatttcacatcagagtattcatattggtgttaagccctatgactgtaaggaatgcgggaaggccttcagactactttcacaactcacacagcatcagagtattcatattggtgagaaaccttataaatgtaaggaatgtggcaaggcctttagattgcgccaaaaacttactctacatcagagcattcatactggcgaaaaaccctttgagtgtaaggaatgtaggaaggcctttagacttaattcatcccttattcaacatctgagaattcattctggtgagaaaccctatgaatgtaaggaatgtaagaaggcctttaggcaacattcacaccttactcatcatctgaaaattcataatgtaaaaatctaagaaagtcttttcaacttctgtgttatagaacattctatgaatgtagtaattaatctattttgctccatacatgcaactgcgttggcattagaggttttataccattaaaagagtgtgacaatgtattgtagtccatcatcactcaaacctgaaacttcagcatatttgttctaaaaactaatcctgttataagaatgagaaagacatttaccgtcatccctatcccatcactttgtgtcatactggacaagacgcttaactgctctgtgctataattttttaatttatgacatggtcatataagagtgcagcagtttgacacactttcaatcaagaggtggaatctacatccctctgttgtatacaggaatctacatccctctgtgactgcttcgcccagtagaatatggtagacgtactgctgtgctggtttcttgactcagactttactggtagggttacttcatctcatgaaatgacagaactgtcttgttacaaagtctggctactttgctgaagagaccacatgaagaggccctgaaactacgtagagagggagaggcacctgctgaaccctgtcttcttgacatccaccaagataccagacatttgagtgaaattttggatccaccagaccagccaccagctaaatgccagtgagcgacttggtaacctgaactgatgccatgtagaatggaagaattgaccagctgagcccctgcccaaatttctgacccacaaaaacatgagatataataaaatggttgttgttttaagccactaaactttcttttattatcatactaaatatttctttttacataattcatactaaaggctgtgggcataatgagtatagaaatgccttccaccaacatttaatcttcattgaacttgagatatcttattctcgttaaaatattgaaagtaaggaattcctttccagtttgttcattaaaaaacagataccctagaccaggtgaggtggcccatgcctgtaaatccagcactttgggaggccaagtaaggacgattgcttgaggccagaagttcgagaccagcctgggcaacatggtgagaccctgtctctaccaaaaaactttaaaaattagctgggcataatggtgcatgcctgtagtcctagctactcgaggctgaggtgggaggatcatttgaacccaagagttgaggcttcagtgagctgtgattgtaccactgcactccagcttgagtgactgcaagaccctgtctcaaaaaaaaaa

SEQ ID NO: 318443 - DNA, 1847 bp, Homo sapiens
aaacttcatactggtgagaaaccctatgaatgtaaggaatgcgggaaggcctttagagtgcgacaacaactaacactccatcagagaattcatactggtgagaaaccctatgaatgtaaggaatgtggaaagacctttagccgtggttatcatcttattctccatcacagaattcatactggtgaaaaaccttacgaatgtaaggaatgctggaaagcctttagtcgctactcacaacttatttcacatcagagtattcatattggtgttaagccctatgactgtaaggaatgcgggaaggccttcagactactttcacaactcacacagcatcagagtattcatattggtgagaaaccttataaatgtaaggaatgtggcaaggcctttagattgcgccaaaaacttactctacatcagagcattcatactggcgaaaaaccctttgagtgtaaggaatgtaggaaggcctttagacttaattcatcccttattcaacatctgagaattcattctggtgagaaaccctatgaatgtaaggaatgtaagaaggcctttaggcaacattcacaccttactcatcatctgaaaattcataatgtaaaaatctaagaaagtcttttcaacttctgtgttatagaacattctatgaatgtagtaattaatctattttgctccatacatgcaactgcgttggcattagaggttttataccattaaaagagtgtgacaatgtattgtagtccatcatcactcaaacctgaaacttcagcatatttgttctaaaaactaatcctgttataagaatgagaaagacatttaccgtcatccctatcccatcactttgtgtcatactggacaagacgcttaactgctctgtgctataattttttaatttatgacatggtcatataagagtgcagcagtttgacacactttcaatcaagaggtggaatctacatccctctgtgactgcttcgcccagtagaatatggtagacgtactgctgtgctggtttcttgactcagactttactggtagggttacttcatctcatgaaatgacagaactgtcttgttacaaagtctggctactttgctgaagagaccacatgaagaggccctgaaactacgtagagagggagaggcacctgctgaaccctgtcttcttgacatccaccaagataccagacatttgagtgaaattttggatccaccagaccagccaccagctaaatgccagtgagcgacttggtaacctgaactgatgccatgtagaatggaagaattgaccagctgagcccctgcccaaatttctgacccacaaaaacatgagatataataaaatggttgttgttttaagccactaaactttcttttattatcatactaaatatttctttttacataattcatactaaaggctgtgggcataatgagtatagaaatgccttccaccaacatttaatcttcattgaacttgagatatcttattctcgttaaaatattgaaagtaaggaattcctttccagtttgttcattaaaaaacagataccctagaccaggtgaggtggcccatgcctgtaaatccagcactttgggaggccaagtaaggacgattgcttgaggccagaagttcgagaccagcctgggcaacatggtgagaccctgtctctaccaaaaaactttaaaaattagctgggcataatggtgcatgcctgtagtcctagctactcgaggctgaggtgggaggatcatttgaacccaagagttgaggcttcagtgagctgtgattgtaccactgcactccagcttgagtgactgcaagaccctgtctcaaaaaaaaaa

SEQ ID NO: 318444 - DNA, 2536 bp, Homo sapiens
aggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318445 - DNA, 409 bp, Homo sapiens
  misc_feature (383)..(383): n is a, c, g, or t
aaatctgtctggcattagctcttattcctgcattcggtctttcttcagtggtccatgaatgcttcttctcctccatggtctggaagcggcatggccaaacttggaggtggtatcagggtggtatagggtggtatagtcctgataccacccactgacagcagcagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatgactntgagaaaaccccagtcacggaacaag

SEQ ID NO: 318446 - DNA, 2583 bp, Homo sapiens
tgccggcccttgtccccttcccccactatcctctccacccgctcccaggggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318447 - DNA, 2606 bp, Homo sapiens
aggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatgtgagtggagctgaaggggaggatcccaaaagtgtcccccagtctgctcatcccaccttctcgcccccagagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318448 - DNA, 2504 bp, Homo sapiens
tgccggcccttgtccccttcccccactatcctctccacccgctcccaggggctggagtctggaaaaccacgcgggaggaggttgtggggatatggacgagcatccgaggcccccggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318449 - DNA, 2100 bp, Homo sapiens
agaaggatccccttcttcttggggcctgtgttatcagttgcgaaaaaaagcaggcaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318450 - DNA, 1445 bp, Homo sapiens
gcgctcgggttaaggtgggtgatggtggctatgatggtggggatgatgaggctattgttttttgtgaattcttcgataatggcccatttgggcaaaaagccggttagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318451 - DNA, 2489 bp, Homo sapiens
aggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318452 - DNA, 2068 bp, Homo sapiens
  misc_feature (2042)..(2042): n is a, c, g, or t
aggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatgactntgagaaaaccccagtcacggaacaag

SEQ ID NO: 318453 - DNA, 1499 bp, Homo sapiens
aggccgagcgggaggtcggggctgcgggcgctcgctggtggcggacccggaggctgctgcggcgccggggctccgtggcctggattgaatccgatcgggagccatgagcgtggacaaagctgagctatgcgggtctctgctcacctggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatcctcatggatccactcacaccggggatactagcgcgaaaccggctgcggagcaggtagacgcccgggctcgtgggacaacgtggcgagagc

SEQ ID NO: 318454 - DNA, 1734 bp, Homo sapiens
tgccggcccttgtccccttcccccactatcctctccacccgctcccaggggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtgatcaaccatttgttcatccattcatctatggagtactcaccctgtgccaggcctgggcattcagcaaggaataacacagacaaaaacctgccccacacagccatcattctagtgacaagcaacacatacacaaccataaaaattaacttccaggctgggcgcagtggctcatgcctgtaatcccaacactttgagaggctaaagtgggtggatcacctggggccaggagttcaagaccagcctggccaacaagttgaaaccccatctctactaaaaatacaaaaattagctgggtggggtggtgtgcacctgtaatcccagttacttgggaggctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttggtgtgatggaggaatggcagagagggcagaacagagcaagagggcaagatttgtaggagatgaggtcatcaggggcctggcaggccatggtgggggtgtggattctatttttaagtgctgtggaaagtcaaggcagggttttagcagagcaaagatgcaacctggcttgggctttataaagctccccctggctgcatggagagaaataaaatgtaggcagcaaaagtggaagaggagaggcagctggtgcactaatccaggtgagaggtaaagatggatgggtagggctgaaggatggtggggcaggtggtgagaagtgacttggttctggagacatatgaaggaagatggtcaggcaggccgggcacagtggctcatgcctgtaatcccagcaattttagaggctgaggtgggaggattgcttgagctcaggagcttgagaccagcctgggctacatagcaaaacctcctctctacaaataaaaaaaagtagtcgattgtggtggcatatgcctgtagtcccagctactgggaggcagagataggaggattgcttgaccccaggaggtcgaggctgcagtgagccaagattgcaccactgcactccagcctgggtgacagagccagaccctgtcttaaaaagctaaagc

SEQ ID NO: 318455 - DNA, 1266 bp, Homo sapiens
tgccggcccttgtccccttcccccactatcctctccacccgctcccaggggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtgatcaaccatttgttcatccattcatctatggagtactcaccctgtgccaggcctgggcattcagcaaggaataacacagacaaaaacctgccccacacagccatcattctagtgacaagcaacacatacacaaccataaaaattaacttccaggctgggcgcagtggctcatgcctgtaatcccaacactttgagaggctaaagtgggtggatcacctggggccaggagttcaagaccagcctggccaacaagttgaaaccccatctctactaaaaatacaaaaattagctgggtggggtggtgtgcacctgtaatcccagttacttgggaggctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttgagaaatatttctttgaatcagggagctagcacctttgagttttccagaaaagcacgtctccccagtgtgtgcactgtgatgtggtgtccaagatccacattgaacatacttcaactacttgtacttagataacatcactctgaagtatactaccaaaatgtcaattgagaagagctgaaaat

SEQ ID NO: 318456 - DNA, 1142 bp, Homo sapiens
ctcagcctctggagtagctgggaataggcgcgtgccaccacgcccagctacttttattttttattttatttttgtagagacggagtctcgctgtgttgccagggctgttctcgaactcctgggttcaagcagtcctccctcctcgacctcccaaagtgctgggattacagatgtgaaccatcgcgccaggcattttattttattttattttatttattttttttgagacagtctcactcttccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttggtgtgatggaggaatggcagagagggcagaacagagcaagagggcaagatttgtaggagatgaggtcatcaggggcctggcaggccatggtgggggtgtggattctatttttaagtgctgtggaaagtcaaggcagggttttagcagagcaaagatgcaacctggcttgggctttataaagctccccctggctgcatggagagaaataaaatgtaggcagcaaaagtggaagaggagaggcagctggtgcactaatccaggtgagaggtaaagatggatgggtagggctgaaggatggtggggcaggtggtgagaagtgacttggttctggagacatatgaaggaagatggtcaggcaggccgggcacagtggctcatgcctgtaatcccagcaattttagaggctgaggtgggaggattgcttgagctcaggagcttgagaccagcctgggctacatagcaaaacctcctctctacaaataaaaaaaagtagtcgattgtggtggcatatgcctgtagtcccagctactgggaggcagagataggaggattgcttgaccccaggaggtcgaggctgcagtgagccaagattgcaccactgcactccagcctgggtgacagagccagaccctgtcttaaaaagctaaagc

SEQ ID NO: 318457 - DNA, 206 bp, Homo sapiens
cccagcagcgtggagctgatgggccacctcttccgccagcagcccggcggatcgaggagctgcagcataacttgcagaagaaggacgcggacttgcgggccatggaggagcgataccgccgctacgtggacaaggcccgcatggtgaggacgctgggtgttcccacaagttgcctgccctggcttcttactttttgtgcctcctat

SEQ ID NO: 318458 - DNA, 431 bp, Homo sapiens
gcttccctctgtgttggaggcaggagggcagcctctgggctggggttattgggcagaactggccttgacgggaggatggagaggttctcaggttggatagtagatactttgaaggctggcctcagatatccagttcattacaatgccccttcccactcctcagctcatgaccaaagacactcctgactccctgtcaccagagacgtatggcaactttgacagccaggtaagagatttgggggaaaggtgttccaggcacagggatcagcaaatccaaaggccgggagttggggataagtttgctgtgattaaccttgtgacttaaccttgttaaaggtccagaccccacttacagatgctcagggtagcctaagggggaggggcttgtccttaagcctgtaagccacgcccatcttccagggtgctagcca

SEQ ID NO: 318459 - DNA, 913 bp, Homo sapiens
  misc_feature (861)..(861): n is a, c, g, or t
  misc_feature (869)..(869): n is a, c, g, or t
  misc_feature (871)..(871): n is a, c, g, or t
  misc_feature (878)..(879): n is a, c, g, or t
  misc_feature (881)..(881): n is a, c, g, or t
  misc_feature (884)..(885): n is a, c, g, or t
ctgcccgatgccccatacaggccattgtaagtaccatgggcccaggatggcaccccctaccctcaccctgggaaggaagaattagggcctctctggatcccccactcaccttgcctcttctctctcccagtccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagagaaatagccggcttagcaggacggggncccccggnanggggccnnancgnnttggaaaaggcccgaaaaaaacaaaaaa

SEQ ID NO: 318460 - DNA, 2549 bp, Homo sapiens
tgccggcccttgtccccttcccccactatcctctccacccgctcccaggggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318461 - DNA, 2435 bp, Homo sapiens
aaaaaaaaaaaaaaaaaaagaaacaaagatggtcaggcagacaaaaggggcagacagccagacaggtcacccctagaggaaggcgcacgcagacagaataggatgagatgagcagggaaggagaagtgaggtggagagaggatgggacctacagattcagagtgggaggcctctgaacttgtccacagttccttgttcctccctaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318462 - DNA, 2560 bp, Homo sapiens
tgccggcccttgtccccttcccccactatcctctccacccgctcccaggggctggagtctggaaaaccacgcgggaggaggttgtggggatatggacgagcatccgaggcccccggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggcctcccccaccttgatccccagaccacatccagagaatcatgacgctggaagaatcggttcagcatgtggtgatggaagccatccaagagctcatgaccaaagacactcctgactccctgtcaccagagacgtatggcaactttgacagccagtcccgcaggtactatttcctaagtgaggaggctgaggagggggacgaattacagcagcgctgtctggatctggagcggcagctgatgctcctgtcagaggagaagcagagcctggcgcaagagaatgcagggctgcgggagcggatgggccggcctgaaggcgagggtaccccaggtctcactgccaagaagctgctgctgctgcaatcccagctggagcagttgcaggaggagaacttcaggctggagagtggcagggaggatgagcgcctgcgctgtgccgagctggagagggaggttgcggagctgcagcaccggaaccaggcgctgactagcctggcccaggaggcacaggccctgaaggatgagatggatgaactacggcagtcttcggagcgtgctgggcagctggaggccacgctgaccagttgccggcgccgcttgggcgagctgagggagctgcggcggcaggtgcggcagctggaggaacgcaacgccggccacgccgagcgcacgcgacaactggaggatgagctacgccgagcgggctccctgcgcgcccagctggaggcgcagcggcggcaggtgcaggaactgcagggccagcggcaggaggaggccatgaaggccgagaaatggctatttgaatgccgcaacctggaggaaaagtatgagtcggtgacaaaggagaaggagcggctgttggcggagcgggactccttgcgggaggccaatgaggagctgcgctgcgcccagctgcagccgcgggggttgacccaggccgatccctcactggatcccacctccacacccgtggataacttagccgcagagatcctgcctgcggagctcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggctgaaccagcagcagctatccgagctgcgggcccaggtggaggacctgcagaaagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318463 - DNA, 1387 bp, Homo sapiens
aaaaaaaaaaaaaaaaaaagaaacaaagatggtcaggcagacaaaaggggcagacagccagacaggtcacccctagaggaaggcgcacgcagacagaataggatgagatgagcagggaaggagaagtgaggtggagagaggatgggacctacagattcagagtgggaggcctctgaacttgtccacagttccttgttcctccctaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagccctgcaggagcaggggggcaagactgaagattccattttgctgaaaaggaagctggaggaacatttgcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318464 - DNA, 1082 bp, Homo sapiens
ggaagatggtggctgaaccagcttgggagctgtgggatgggaagaagtggacagcaggggctgttccggggcatacctgctaagggtgcggagggttgtggctctgacagctgtggagccggtgggaccagggcacacagccccaggcatgaggggcaggcagagagggctctgtggccatgtaggggcatttctggctggcggggaggtctgtggctaccactgggacaaaagagaagccagcccggaggtcagcccactgctgctcatccccggcccacaggcagaagcttcatgaggcagatctggagttgcagaggaagcgggagtacattgaggagctggagccacccactgacagcagcacagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318465 - DNA, 790 bp, Homo sapiens
ggacctagtgaccagagggtggggagatcccagagcccagcagcgtggagctgatgggccacctcttccgccagcagcccggcggatcgaggagctgcagcataacttgcagaagaaggacgcggacttgcgggccatggaggagcgataccgccgctacgtggacaaggcccgcatggtcatgcagaccatggaacccaagcagcggccagctgcgggggcacctccagaactccattccctgaggacacagctccgagaacgggatgtccgcatccgacacctggagatggactttgagaaaagccgaagtcagcgggagcaggaagaaaagctgctcatcagtgcctggtataatatgggcatggccttgcagcagcgagctggggaggagcgggcgcctgcccatgcccagtcattcctggcacagcagcggctggcaaccaattctcgccgtggacccttgggacgcctggcatctctgaaccttcgccccactgacaagcactgacagacctcacaatcaagccagcctgggctccacccaccctggcttcctccagctcacatggcgcccagcactgggcttcagccaggtgctcgagagctttgaggccatgatctctgctcttccctctcccagattggtggggagggagggcgggaggtagatataggcctgttctttttagcaatgtgattcttgttgttgattctctctctggagttcatgtgctgcctcaggagactctgattttatatttgagaaaaataaaggcgttcaatctgc

SEQ ID NO: 318466 - DNA, 1827 bp, Homo sapiens
tgccggcccttgtccccttcccccactatcctctccacccgctcccaggggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatagacccctcctggttcaacgaggcatggctccagggcatctcggaagatccaggtcccaactggaagctgaaggtgacaagtggactcctgattagaggacagactggtgaagagatgaccagggacgggccagctaggcacatgtcctgggtgatgggcaggaagagggacagatgtctggtgatcaaccatttgttcatccattcatctatggagtactcaccctgtgccaggcctgggcattcagcaaggaataacacagacaaaaacctgccccacacagccatcattctagtgacaagcaacacatacacaaccataaaaattaacttccaggctgggcgcagtggctcatgcctgtaatcccaacactttgagaggctaaagtgggtggatcacctggggccaggagttcaagaccagcctggccaacaagttgaaaccccatctctactaaaaatacaaaaattagctgggtggggtggtgtgcacctgtaatcccagttacttgggaggctgagacatgagaatcacttgaacctgggaggtggaggatgcagtgagctgagattgagccattgcactccagcctgggcaacagagcgagactcttgtctcaagaagaagaaaaaaagaaaaagaaaaagaaaaagaaaaaacttttgatgccagtagttctgtgaagacaacaaaaaagcagggctttgagagagagcaatgagggcataggtggctgattacatcagatgggttaatctccaagtgaaatttgggggaacggtgttccaggcatagggaatagcagatgtaaaggccgtgatttgggaataaacttggtgtgatggaggaatggcagagagggcagaacagagcaagagggcaagatttgtaggagatgaggtcatcaggggcctggcaggccatggtgggggtgtggattctatttttaagtgctgtggaaagtcaaggcagggttttagcagagcaaagatgcaacctggcttgggctttataaagctccccctggctgcatggagagaaataaaatgtaggcagcaaaagtggaagaggagaggcagctggtgcactaatccaggtgagaggtaaagatggatgggtagggctgaaggatggtggggcaggtggtgagaagtgacttggttctggagacatatgaaggaagatggtcaggcctgggcattcagcaaggaataaccagacaaaacctgccccacaagccatcattctagtgacaagcaacacatacacaaccataaaaattaacttctggctgggtgccgtggctcatggctgtaatcccagcactttgggaggtcaaggcaggcggaacatgaggtcaggagtttgagaccagcctggccaacatggtgaaaccccatctctactaaaaatacaaaaattagctgggcatggtggtgggtgcctgtaatcccagctactcaggaggctgaggcaggaaaatcatttgaacccgggaggcggaggttgcagttagctgagattgtgccactgcgctccagcctaggcgacagggcaagagtccatctcaaaaaaaaaa

SEQ ID NO: 318467 - DNA, 826 bp, Homo sapiens
tgccggcccttgtccccttcccccactatcctctccacccgctcccaggggctggagtctggaaaaccacgcgggaggaggttgtggggatatggacgagcatccgaggcccccgggtgcgtacggctgcgcatgagtgggctgtaatcgggtgtctggggttacagacgttccacgttccgtctccctgtgccagccctcaggacctgagcagcggccttgccgtagcctatgtgctgaaccagatgtgagtggagctgaaggggaggatcccaaaagtgtcccccagtctgctcatcccaccttctcgcccccagagacccctcctggttcaacgaggcatggctccagggcatctcggaagatccaggtcccaactggaagctgaaggtgacaagtggactcctgattagaggacagactggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggcctcccccaccttgatccccagaccacatccagagaatcatgacgctggaagaatcggttcagcatgtggtgatggaagccatccaagagctcatgaccaaagacactcctgactccctgtcaccagagacgtatggcaactttgacagccagatggagtctcactctgtcacccaggctggagtgcagtggcacgatctcggctcactgcaacctcc

SEQ ID NO: 318468 - DNA, 369 bp, Homo sapiens
aatgggagttgtcaggtttcctcaatcccaaggtggctaaaagcatgccagccctgtagcagatcgagggcgctccctgcttcttccttaaagggccctgtccaggctggtcgggtgggcaggcattaaccatgtaactgtactttctcacttgtgttggggcaggtaacttcctgctaggggtttcctctctatgggtgttgtagacctagaaatagagtcctaggtgctcagtgttacggggccagctgacactcccgccagcagggaaagaacaggaggttgcccccggatcggctatcaccaggagacccaggctcaggccacaggccctgtggtctccaccccgcagtcagaccagcgtcatgg

SEQ ID NO: 318469 - DNA, 4940 bp, Homo sapiens
gggctttgtagactcaagactgctgagaagaatcaggcagtcatgtaaaggggttgaaggcatgtgtgtttccttccaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagagtgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttggacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgcttagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacatatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgt

SEQ ID NO: 318470 - DNA, 3005 bp, Homo sapiens
cagcggacaacacggcgtgcccccctggcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttggacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgcttagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacatatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgt

SEQ ID NO: 318471 - DNA, 4789 bp, Homo sapiens
cgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagagtgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggtgggacatggacacagctcaaaaaggcagtgcctgccttactcctctggcttggaccactcagccttaagcgggacaataaccccctgacacttaaccctgtgttgagctatggggccatctctagcagagtcaagtcaaaacaggggactctgcacaactgttattcagtgagtgtgaaaagtcttagcctagatcccaaatcactgccctcaccagcaaaggcatgtttcattccttctgccaaaacatgcagcagaatcggatagtggttaagagcatgtctctggaatgagatgctcagtgtgagtcttgtgtggccttgggcatattgcttagagtctgcttccacgcgcctccctacctggcctgggatggtgtccagcttctgacccagctgctggtccattcagagttgttactacaagggccaggaagtaaccatggtgccaatcctatagttgaaccccaaatagatgatgaaagaagaatatgctctcctttttttcttctcccatcctctgcccccctcccactggaagcaaaggcaccactgaagaacattacatctttggagctcttaataagcaatcaggacttcgttttaccgtgacccatttttttgtttttgttttttcgagatggggactcactatgttgcccaggctagaatgcagtggcatgatcacagctcactgcacccttgacctcctaggctcaagaaatcctccaacctcatcctactgagtagctgggactacaggcacatgcactgcacccagctacattcctttttttatctgaatgttccataataacttggagaaattggctgagatgtaccaaattttgtaggaaattgaaggagctcaaggcagactttaatttcactctgccaccctaattcaaaacagcagccaatgcaaatgtacagatagacatattttctaagattgatccaagtgaaatcagcagttcacaaagttattatgactatacccctacaggacactgaaggggggtgtttttaccagtgcttagctactgactattcttagctactaaccaggtcttaagaataatgtagaagtcatgttatatggagttgagttgctaacttttttccttttcctcagtttccagatgagtttagcagtaaagatgcttttcccaggcacaaattgggaatgga

SEQ ID NO: 318472 - DNA, 3338 bp, Homo sapiens
cgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagagtgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacaggtagagggcagtgggtctctattcttttacacaggagcagtttctagccagcttctttttctgaccccactgtgatttttttatctcaccatcctctctgacaagacatgctgaaagatttttcatctgtgtaatgttgatgaaacggtgttgccagatctcaagtgttcttccccgtcctacctgacaccctgtgtccttttctttttcagagcagaccctcaaagcagagtttactctagctataccagtcagaaagagagtaaagactttcattagttgatttgtcattaaagtcaatgtagggaaccaccttta

SEQ ID NO: 318473 - DNA, 357 bp, Homo sapiens
gtaggagccacctccatgcaagtcagccatgggccttcggatgatttcatcaatatagccaagggctcagtgcggtggtgcttggggttagcacagagagtggggatttcttcctgactgaattttttattcttatataactgaaaatttaatgtgccttgtttcctgctttctctctcgatacctttagcatgtatattgttaagtatgaaatcagtgggtgactctgcactttataaataggcaaaaatctaaaaattcaataacatgatagttgattagactgtaggaaaacagcattctcagagaatgcaagtgggacataaatttgtacagcctctgtcggaaggcagtttg

SEQ ID NO: 318474 - DNA, 6544 bp, Homo sapiens
cgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagagtgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggttcgggcctacctgatatgttgcaaactgcgttctgcctacttgattgctgtgaagcaagaacactcacgggccacagcccttgtccagcaggtgcagcaggccgccaagagcagcggggatgcagtagtgcaagacatctgtgcccagtggcttctgacaagccacccccggggtgcccatggcccaggctccaggaagtgaccttgggcagtggggccaggaacacgtggcctgagagctgggcaacagcagtgatggcgatgccctccacctctttcctccagtggagtgggacttctctggctctgccctaggttggaaagagttggattggaccctacttgccttcccgggcaaggataggacctttcacgcaagtgccatgtttctctaaaattgtggaatctatgtgtgtttgtctggagatggccagttctttctacctcagagtgagtgagtgagtatgtgtgcacacacgtgtgcatgttcctgtgcgctgatgtttacgcccaagcatttctgaacaaatgaaactcttctccatttaaaagaggcactttactttggacttgccactctgaaaaccttccctgcgttttggttcttgacccgggttgtcctgtttgtatagtcccccctctgtggacgtgctttagtagctcctcttacctagagggcttttacagagaattagagcaacaccaaaaggattgcctcttttccttccttcccattccaaaattcagagatggctttggggcaagtgctacctgtggaataaacctgttttccaggtgtctcttctcccaagcacaagaagtcctggagtctttggaaggtagtctgaatagaagggttttcaggtgcaggcatctgaaagctgtgggtatgtgtataaatgatcaggtctgtgaggctaacacgggcaagagggaaagaaaggctaaccatccaaacagggatacaggggaggcggtggggggtggtggggggagcgggtgctcacaagcacagagctgcctgttgtgaatgtccctgctgcaaagttggtgggtgagagaatgggacttcctctttgagagtctggggagagaaaaggtggccaggatcctaggactgaatgactcgattttacctatttgagctgcagtcctgtttgcgctccttgaattggttaggaagctgcttccttttccctcctgcttcccttcagtctcttcaggaccacaggatggatatgcagacatgtggggtcattgggaagggagtgcgcttcttttctctgtcttagaaaagggagtcaagggttggctttggaattgggcctctggacagagtcagaatgagggaataatgaataggtcacatctggttggtggaaaactaggtgaagtgcttctttaatatgcactgtcttgtcttcccacgcaagatgtgacaatgtttgagaaaaggtgtgtcatactcagtgacttcaatttgcaaatgtggggcctaaagaaagctctgcagctctgaacctctcactggccagagctcagcctattggtcccatccatgatgctgagacaaacagaaactggaagctgaagtcagtgtctctggtgcttagaaaccctgtggatttccctctgaaccaagatttttagtagtaaaataaacaactcatggacatctgtcagatgagaagttttggtcctgttagagaggagaaagactgtaatgaaactactagacccatttgggctaaagtttggcttttccttccttgagtcatagaacatatccatctcccaggaaatgtccttctctggcgtctgcttgcccttctgagtctgccttttttgcactgaacataagcactttatactaatgggtcacaaatcttgcagcccttaatttgggataagaccagattttcctgacattttcctctaactcattgaactatcaaattataggcaaccactgactagactgatatgagatgaggctaaaagcctttgaacaccacgctgtagtctccaacagaaaaacaccaccaaaacagatacccatgttgaggggttgaatgttttactacaaacaagccacaataaagtgtctatcaacatgt

SEQ ID NO: 318475 - DNA, 5003 bp, Homo sapiens
  misc_feature (4986)..(4986): n is a, c, g, or t
cgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagagtgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttgcaagatgacgattactttgccaccctgagggaactggaagctacccttcggacgcagagcctttctctggcagtgattcctgaagggaaaatcatgaacaacacctactaccaggaatgcctcttctacctgcacaactatagcaccaacctggccatcatcagcttctacgtgaggcacagctgcctgcgggaagctcttctgcaccttctcaacaaggagagtcctccagaagtttttatagaaggcattttccaaccaagctataaaagtgggaagctacacactttggagaacttgctagaatccattgatccaaccttggagagctggggaaagtacttgattgctgcctgccaacatttacagaagaagaactactaccacattctgtatgagctgcagcagtttatgaaggaccaagttcgggccgccatgacctgtattcggttcttcagtcacaaagcaaagtcatatacagaactgggagagaagctctcatggctacttaaggccaaggaccacctgaagatctacctccaagaaacatcccgcagctctggaaggaagaaaaccacattcttcagaaagaagatgactgcagctgatgtgtcaaggcacatgaacacacttcagctgcagatggaagtgaccaggttcttgcatcggtgcgaaagtgctgggacctctcaaatcaccactttgcctctgccaaccctgtttggaaataaccacatgaaaatggatgttgcctgcaaggtcatgctgggagggaaaaatgtagaagatggttttggaattgctttccgtgttctgcaggacttccagctggatgctgccatgacctactgcagagctgcccgccagttggtggagaaagagaagtacagtgagatccagcaactgctcaaatgtgtcagtgagtcaggcatggcagccaaaagtgacggggacaccatcctcctcaactgcctggaagcgttcaagagaattccgccccaggagctggagggcctgatccaggcaatacacaatgatgacaacaaggtgagcggaattgtctccaaacgctggtgatgccaatgaattgtgtctcaggcttgcctagtcacctttatcccttgctccccacaatagttccatacaacccgtatctcagcttctgtattatcagaggtggagctgaggcttggataggggtgtagaaaggagggaatagatgaggagcaggtgaacatggactgcatgcgtctttgccttcccaagtctttatccccaagacaaacatgtcctaggctgctcttgaatctccattttatactgatgtcttctctcagagagccctaggaaatccctcacctcacctccatctttgggtggactgatggattgaggttcccagagtaagcaggtatctctttatcctagagggaaaaaggtacagtaagaaaaaaatccccaccccacactttgaccaacaatgtccaacaatgtctcggtctccagaatgaacctctcctcaggggccaaagaactcgtccctgtttgggaaaatggtgaacctttgcttcccgttgcctttgggaggagtgccagtcagaataaaantcttcccagatgccccc

SEQ ID NO: 318476 - DNA, 3639 bp, Homo sapiens
cgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtgacaaagaaggttggcaatacctgtttcccgtgaaggatgcatctctgagaagtcggctggccctacagtttgtggacaggtggcccctggagtcatgcctggagattctggcctactgcatttcagacacggctgtccaagaaggactaaagtgtgagctacagaggaagctggcggagctgcaggtgtatcagaagattctgggtttgcagtctcccccagtgtggtgtgactggcagaccttgaggagctgttgtgttgaggacccatcaactgtcatgaacatgattctagaagcacaggagtatgaactgtgtgaagagtggggctgcctgtaccccattccaagagaacatttaatcagccttcatcaaaagcatcttctccaccttctagaaagaagagatcatgacaaggctctgcaactcctgcgaagaatccctgaccccaccatgtgccttgaagtgacagagcaatccctcgaccagcacactagcttggccacttctcacttcttggccaactacctcaccacccacttctatggacaactgactgctgtccgacaccgtgaaatccaggcgctgtatgtgggatccaagattctgctgaccctgcctgagcagcaccgggccagctattcccacttgtcctctaaccccctgttcatgctggagcagctgcttatgaacatgaaggtggattgggccactgtggctgtgcagactctccagcagctgctggttggacaggagattggcttcactatggacgaggtggactcactgctttccagatacgcagagaaagccctggactttccataccctcagagggagaaacgatcagattctgtgattcacctccaagaaattgtccaccaggctgcagatcccgagaccctccctagatcaccatcagcagagttctctcctgctgctcctcctggtatctccagtatacattcccctagtctaagggaaaggagtttcccaccaacccagccctcacaggaatttgtgcccccagcgacaccccctgccaggcaccagtgggtaccggatgagactgagagtatctgcatggtctgctgcagggagcacttcaccatgtttaacaggcgtcatcattgtcgccgctgtggccggctagtgtgcagctcctgctccactaagaaaatggtggttgaaggctgcagagagaaccctgctcgtgtgtgtgatcagtgctatagttactgcaacaaagatgtaccagaggagccttcagaaaaaccagaagctctagacagctccaagagtgaaagccctccatactcgtttgtggtgagagtccccaaagcagatgaggtggaatggattttggatctcaaagaggaggaaaatgagctggtgcggagtgaattttactatgagcaggcccccagcgcctccttgtgcattgccatcctgaatctgcaccgggacagcattgcctgtggtcaccagctgattgagcactgctgcaggctctccaagggcctcaccaacccagaggtggatgccgggctgctcacggacatcatgaagcagctgctgttcagcgccaagatgatgttcgtcaaagccggccagagccaagacttggctctttgtgacagctacatcagcaaggtagatgtgctgaatattttagttgctgctgcctatcgccacgtgccatctttggatcagatcttgcagccagctgcagtaaccaggctaaggaaccagcttttggaagccgagtactaccaactgggcgttgaggtctccacaaagactgggcttgataccaccggggcgtggcatgcttggggcatggcctgcctcaaagccgggaacctcactgctgcacgggagaagttcagtcgctgtctgaagcccccatttgacctcaatcagctgaatcatggctcaaggctggtgcaggatgtggttgagtacctagagtccacagtgaggccctttgtatccttggtaagagcaaggcaggaagagtgcctggctcagggagggagacccaggaatagcaatgacctgggaaaagaatcagtggaaattcagctaacagtgtcagtcctggctcagcatcaagcaggttaaaaattttttttttccatcacatatagttagataagtaaccatatatggttagataagtaatagatgtaattttttttaaaaaaaggagacaatttttaaaaagataaaaatgacatatgacatataatcccatac

SEQ ID NO: 318477 - DNA, 1606 bp, Homo sapiens
cgtttgaatagtagccttgaaaggcggggtcgacggatagaccacgtactcctaaatgctgatggcattcgaggttttccagttgttcttcagcaaatcagtaagagtctcaattatctgcttatgtcagccagtcaaaccaaatcagagagtgtggaagaaaagggaggaggccctccacggtgcagcatcactgaactgcttcagatgtgctggcccagcctaagcgaggactgtgttgccagccacaccaccctctcccagcagctagatcaggtccttcagtcactgagagaggcactagagctgccagagcccaggactcctccactgtcttccctggtggagcaggcagcccagaaagctccagaggcagaggcccaccctgtgcagatccagactcagctcctccagaagaacctgggcaaacagaccccatcaggcagcaggcagatggactacttgggcaccttcttcagttactgcagcacccttgctgcagttctccttcaaagtttgagctctgagcctgatcatgtggaggtcaaggtaggaaatccctttgttctgctgcaacagagctcttcccaactggtgtcacatctcctgtttgagagacaagttcccccagagagactggcagcccttctggcccaagagaatctcagcctaagtgtgccacaggtcatcgtcagctgctgctgtgagccccttgctctttgctcatcccggcaaagccagcagacctcctccctcctgactcgtctgggtactctggcccagctacacgcctctcactgcctggatgacctcccactttctacaccgagctccccgaggacaactgagaaccctacattggaaagaaagccctactcctccccaagggactcatcactcccagccctcacctcctctgccttggcctttcttaagtcacgctcaaagctcctagctacggtggcctgcctgggggcttccccgaggttaaaggtcagcaaacccagcttgtcatggaaggaacttcgtggccgcagggaggtgcctctggctgcagagcaggtagcccgggagtgtgagcgccttctggaacaattccctctgtttgaggccttcctcctggctgcctgggagcccctgcgagggtctttgcagcaggggcagagtctggcagtgaatctctgtggttgggccagtctttctaccgttctcctgggcctacattctcccattgccctagatgtactgagtgaggcttttgaggaatccttggtggccagagattggtcccgggcccttcagctcactgaagtgtacgggcgagatgtggacgatttgagcagcataaaggatgcagtcctgagctgtgctgtggcatgtggtgagcagaatgctatgcctccctttttcactagtggtaatatttggtattcactgggtatattatcacatttaatcctcacggtaactctagagagaagccccactataatctcatgttattaagaggagaccaggtctcagaggggttaggaaacttgcccagggtggtaagtggtagagtagagcttagaacccaagtccatctgactttaaacagccacgc

SEQ ID NO: 318478 - DNA, 914 bp, Homo sapiens
cgtaaagaaggaatttgaagaggaatcagtaaaaagaaggagatggctccattaatcaagtgtgaaagacttttccaggaaacaggctagtgtaaaagctgcaagtgaaatgtataaatacagatctaaggttttaaaagaagatacactgctcttgaattatggctcctaaaaaatccaaggtagaagcaaaatcactgaaaatatttcaagagctggcatttggatatcttggttattaggagtaaacattttgaagcaaaacatgtgattaaggctcttgagaagaggagcttatcctgcattatccaggtaagccctaaatgcaatcatatgtatccttataagacaggggcagagggagatttgacatgaagggaaggcaatgtgaaggtgaaggcagagataggagtgatgtggccacaaatcgaagaatgccacggaatgccagtagccaccagatgattgagaagcaaggaacaaattctttcccagggcctccagagggagtatgtccctgctaatactttgatttcagacttctggcctccagactgataatgcatttctgtttaaagccccccagtttgtggttatttgttacagcagccgcaggaaactaatgtatcattctgaggtcccccaaatctcaacccattgcagttcaagatagagtccaaaatctcattagctgagaagtatggcgtaccagaaaagaagtgactactgtaataaaaggcatacatctaaagattagaagacatgatgaaaacatcttccatcagtgctatagtttgaatgtttgtcccctccaaaattcttgttgaaagataattcccagtgtaacagtattgagagatgggccctctaagaagtgattgagttatgaggactctgcccttatgaatggagta

SEQ ID NO: 318479 - DNA, 395 bp, Homo sapiens
taaataaaacacgtccctctgaaggagtgaatggcaggagacacatggaaagccccaaccaccatgttctcccccgactcctgaaaaacagtggctaaactccttggatttgccgttttttccttcctttcttagcagaggagtagccgttgggaagcattgggtcaagtctggaaaataaacctacggacagcttgtctctacaattccaacctaaattggtgaaacaatctgaaacccactactaaccacctccaaaggaataagatatgcccccgatttggtataacaaactcacgttttggactatgaacagagttacggaaaaagagaagaaaccaattctacaaacagctctatcttaacttccccttttccccaccacctaagcagta

SEQ ID NO: 318480 - DNA, 1368 bp, Homo sapiens
gcgggggtcggagccgcaaggctgcggcggcgacgagctccgagcgggacactgaacggcccgtatgcgcaagataagcacggactgaatcaggtacacgcacctgccggggacgcactgaccgaggtgcggacggcggtaccaggacaggtaaagccgcgaacactcggacctaagaacttgacaggtacaccctgcctgatgaagctacgtacggccaggtgcgcatcgagtgaatcagagacgaagtttcgccatgttgcccaggctgatctcaagctcttgggctcaagcaatccacctgccttggcctcccgaagtgctgggattacagggtgagaacctacttcttcataaagagaatttggagggagctttttgttctgcggggacaacatctggatttgaatacatccatgctcaaaaggagatttctcataatggacccaactgaaagcactcagagtacaaggaccggtgagctttcaaaaggagacacttcgggagactcgccaggggccctcgtatccccggcagcgcgagttttggaggtcagtggagggctctcgcatcatgcatgtaactttcatactcaaagacttaccttcatcctgcatccctcacccccctgcagaaacttggggcttgaattcatttaaaaacatttgcggtttcagaagccttctttttattatgaagctgccaaggagatcttagaatgaaaggcatttttagagatgagaaagaaggaagccaggccaaggccgggccggctctcagctgtgggtctgtaaaggtgacacgtgggacatggccacctgcagaccctgcaggcggctgggcagaggcacccacagggacctgggtttgaatccctgctctgccagtcatttccacagcgatcttgggggaagttgtgtaacctctgggccctgcgacgccctttcctggagcctggagctggaacgaagccccttggagccctgacatcagaggtgacgttagtcttcgcaggcaatgactcggcggaatgtgatgccactccctaacccgtgtccggactggcagagtgtgtgccgcctcccaccaggtggtctggctgctttgatggatctcctaacttctctgcaccccagagccctcagtgctggccagaccttcactcactcctgggtgacaaccccgttctcagatagtgggtcccacaggctggcctgtggcgccccctgctggtgactgcagggagaaggatgccctaagccaaaggaagtccttcctggggtctaatctctaccttttgcatgatgaggcagctgaggtggctcgctttctcctccaccccagaaaataaagtcatatggagtccaa

SEQ ID NO: 318481 - DNA, 401 bp, Homo sapiens
  misc_feature (306)..(306): n is a, c, g, or t
  misc_feature (364)..(364): n is a, c, g, or t
gcgggggtcggagccgcaaggctgcggcggcgacgagctccgagcgggacactgaacggcccgtatgcgcaagataagcacggactgaatcaggtacacgcacctgccggggacgcactgaccgaggtgcggacggcggtaccaggacaggtaaagccgcgaacactcggacctaagaacttgacaggtacaccctgcctgatgaagctacgtacggccaggtgcgcatcgagtgaatcagcatcgtattaaccagaagctgcatttacctgggaccatacatcagcccgagcctgtttccagtgnaagagttgtgttcgtgcttgggagggaccatttcattcacaacttgccccagcttctnggaggctcttcctggggtttgggtgtcttaaggttca

SEQ ID NO: 318482 - DNA, 1275 bp, Homo sapiens
gcgggggtcggagccgcaaggctgcggcggcgacgagctccgagcgggacactgaacggcccgtatgcgcaagataagcacggactgaatcaggtacacgcacctgccggggacgcactgaccgaggtgcggacggcggtaccaggacaggtaaagccgcgaacactcggacctaagaacttgacaggtacaccctgcctgatgaagctacgtacggccaggtgcgcatcgagtgaatcagggtgagaacctacttcttcataaagagaatttggagggagctttttgttctgcggggacaacatctggatttgaatacatccatgctcaaaaggagatttctcataatggacccaactgaaagcactcagagtacaaggaccggtgagctttcaaaaggagacacttcgggagactcgccaggggccctcgtatccccggcagcgcgagttttggaggtcagtggagggctctcgcatcatgcatgtaactttcatactcaaagacttaccttcatcctgcatccctcacccccctgcagaaacttggggcttgaattcatttaaaaacatttgcggtttcagaagccttctttttattatgaagctgccaaggagatcttagaatgaaaggcatttttagagatgagaaagaaggaagccaggccaaggccgggccggctctcagctgtgggtctgtaaaggtgacacgtgggacatggccacctgcagaccctgcaggcggctgggcagaggcacccacagggacctgggtttgaatccctgctctgccagtcatttccacagcgatcttgggggaagttgtgtaacctctgggccctgcgacgccctttcctggagcctggagctggaacgaagccccttggagccctgacatcagaggtgacgttagtcttcgcaggcaatgactcggcggaatgtgatgccactccctaacccgtgtccggactggcagagtgtgtgccgcctcccaccaggtggtctggctgctttgatggatctcctaacttctctgcaccccagagccctcagtgctggccagaccttcactcactcctgggtgacaaccccgttctcagatagtgggtcccacaggctggcctgtggcgccccctgctggtgactgcagggagaaggatgccctaagccaaaggaagtccttcctggggtctaatctctaccttttgcatgatgaggcagctgaggtggctcgctttctcctccaccccagaaaataaagtcatatggagtccaa

SEQ ID NO: 318483 - DNA, 359 bp, Homo sapiens
gcgggggtcggagccgcaaggctgcggcggcgacgagctccgagcgggacactgaacggcccgtatgcgcaagataagcacggactgaatcaggtacacgcacctgccggggacgcactgaccgaggtgcggacggcggtaccaggacaggtaaagccgcgaacactcggacctaagaacttgacaggtacaccctgcctgatgaagctacgtacggccaggtgcgcatcgagtgaatcagatcatcactacgaagagcaaaacaggccacttgcccaccttgacagagctggtaagtggcagagccaggaccatccagacggctcagcttccaagccagcaagcctcatcgccatgca

SEQ ID NO: 318484 - DNA, 665 bp, Homo sapiens
gcgggggtcggagccgcaaggctgcggcggcgacgagctccgagcgggacactgaacggcccgtatgcgcaagataagcacggactgaatcaggtacacgcacctgccggggacgcactgaccgaggtgcggacggcggtaccaggacaggtaaagccgcgaacactcggacctaagaacttgacaggtacaccctgcctgatgaagctacgtacggccaggtgcgcatcgagtgaatcagagacgaagtttcgccatgttgcccaggctgatctcaagctcttgggctcaagcaatccacctgccttggcctcccgaagtgctgggattacagggtgagaacctacttcttcataaagagaatttggagggagctttttgttctgcggggacaacatctggatttgaatacatccatgctcaaaaggagatttctcataatggacccaactgaaagcactcagagtacaaggaccggtgagctttcaaaaggagacacttcgggagactcgccaggggccctcgtatccccgagtatagcggtccacgccgatgggtacaaccacagctctattcccatggacccagaacatgtagagctggtgaaaaggacaatggctggagtaagcctgcctgcgacaggggttcctgcctgggctcgggag

SEQ ID NO: 318485 - DNA, 2931 bp, Homo sapiens
tttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttaaaaaaaa

SEQ ID NO: 318486 - DNA, 2697 bp, Homo sapiens
tttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttaaaaaaaa

SEQ ID NO: 318487 - DNA, 1856 bp, Homo sapiens
aacccttccctattcattccattgcagagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttaaaaaaaa

SEQ ID NO: 318488 - DNA, 2217 bp, Homo sapiens
tttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccaagacgtgctggaaaggttgagcccagagtggccgaggctggaccctgtggcaccaagtggggtcggctgaccgtgtggcaggtatcgtagcactggactcttggcgtgtgggaagggatgctttctctttgtcgcccattcttcattactgtttctcatcagttcccctgtgcagatgggctgtgaaattaaattggagtcttgataagaacattttaatttgacttaatattttaaagattgaatccagatcacttgttgctgtcttaatggaatggttttctacaggagctgtaacatacttaaaaatatgaatgtattatgtaaatatggcttctttacataaaaaataaaatgtcaacactgtacttttctgaacaca

SEQ ID NO: 318489 - DNA, 1304 bp, Homo sapiens
tttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcaggtcagtaccctgcttggcctcagctttactgagctgagctgtggcaggtgatgaagggggatgtgtgagtctctactgtgtgagtctctgcggtcaacctgggtctctacaatgcatgtaaggctcaaagcagggacctgaaggctactcactgctttaggggagcttccccacgccacaaagctgttcatgccacaaacatttactgatcacttcctgtctgacagaaacagaaagtgtgacaggcagtgggaattggggaaaaacattaagagaagctccttatgtaaagtcaaatgacaaaatgggaaaacatatatatatttacaaactcatagagaaagagctaatctttttgaaacagaagagtttgaaaactgagtaaaaaatattaacaaaggtcatgaattgttaattcacagga

SEQ ID NO: 318490 - DNA, 3002 bp, Homo sapiens
tttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtgatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttaaaaaaaa

SEQ ID NO: 318491 - DNA, 2078 bp, Homo sapiens
catgacccacagctctccccttcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagagagaagctccaggaggaactcaagtggaggaaaatccagtacatggctcgtggagagaagtctttggcctatcatgaatggaaaatggccctcttcaaacctgcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttaaaaaaaa

SEQ ID NO: 318492 - DNA, 1121 bp, Homo sapiens
tttcttcggaatgagagactcaaccataatagaaagaatggagaactattaaccaccattcttcagtgggctgtgattttcagaggggaatactaagaaatggttttccatactggaacccaaaggtaaagacactcaaggacagacatttttggcagagcatagatgaaaatggcaagttccctggctttccttctgctcaactttcatgtctccctcttcttggtccagctgctcactccttgctcagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattcccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgcttaaaaaaaa

SEQ ID NO: 318493 - DNA, 441 bp, Homo sapiens
ttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcagtgcaggtgagcctccaggttttgttctgagaacacttctctgtaggatctagagcagatgcagagtccctcttccaaaagtactgcagacactcctggctgctcactagcaattgtctgcactgcctcccaacttagcttctctgcaacccttaagaaagacacattctttctttagaaagaattcctgctgtaccttacatgccgaagtaaac

SEQ ID NO: 318494 - DNA, 2153 bp, Homo sapiens
tgatgtttccccatcttgcgttccttcacactgtgtacatgctcttattggaaccctgggtaatctaactgttattgattcaatctttctgtaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaag

SEQ ID NO: 318495 - DNA, 1713 bp, Homo sapiens
aggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtctttcctct

SEQ ID NO: 318496 - DNA, 1688 bp, Homo sapiens
agaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtctttcctct

SEQ ID NO: 318497 - DNA, 736 bp, Homo sapiens
tattgtaaaatctttagtgtctctgaattgattatttcaaaatggtgtcaaatgccagtagtcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318498 - DNA, 343 bp, Homo sapiens
ttgtgaagcctactcctttatttgcaggtcataaaaaaatctaacgagtcattctttatttcttcaattgtatcagctagaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatgtgagtatcttccgcttggaggcattttctcagtacaagttcatatcagggggtggggtcttcggacataattaataactattgagtaatataa

SEQ ID NO: 318499 - DNA, 6498 bp, Homo sapiens
aggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttggttctcagatttgtaggtgcataggtgtgtgtttcaaggaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318500 - DNA, 6446 bp, Homo sapiens
ggcgccggccgcggctagcgcgaagcatgtgccgggcgccgcagccaggactgcggcgcggcgcctccccgggcggcgggcggcgcctcaggcccgcggggcggcggtagcggctgctgcaggatgtccggcccgggggcgcggggccgcgcagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttggttctcagatttgtaggtgcataggtgtgtgtttcaaggaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318501 - DNA, 5725 bp, Homo sapiens
aggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttggttctcagatttgtaggtgcataggtgtgtgtttcaaggaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcccccacactttgcctgaggtccggaaccgttcgcacccggcctgccccagtcaggccgttttagaagagcttctacttgggcgcccgccgtctctggcgcgaacattggaatgcatataccaccatctgttctgtgttgcttactcctggatacatttgatttcatcgcgtaagacctcagatacttatttacgagcgtggcatgtactaaagggttaatgaagca

SEQ ID NO: 318502 - DNA, 6692 bp, Homo sapiens
  misc_feature (18)..(18): n is a, c, g, or t
  misc_feature (35)..(35): n is a, c, g, or t
  misc_feature (42)..(42): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (85)..(85): n is a, c, g, or t
  misc_feature (90)..(90): n is a, c, g, or t
ccatgatcttgttttccnaaaacaagtttttcttntgaagantgggggntaaataacagggntgncttattgagtattcctcccngggtnaaaaaccaaaagaattccttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccaggtggcaggttgctgctctctccttcagaaccccgctctgaggaaagctaaggaagagaacaggacgtctgagtgtgtgactgagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttggttctcagatttgtaggtgcataggtgtgtgtttcaaggaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318503 - DNA, 3873 bp, Homo sapiens
aggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaag

SEQ ID NO: 318504 - DNA, 5582 bp, Homo sapiens
tggagttggatgtgtgagtgtgcccagagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttggttctcagatttgtaggtgcataggtgtgtgtttcaaggaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318505 - DNA, 4067 bp, Homo sapiens
  misc_feature (18)..(18): n is a, c, g, or t
  misc_feature (35)..(35): n is a, c, g, or t
  misc_feature (42)..(42): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (85)..(85): n is a, c, g, or t
  misc_feature (90)..(90): n is a, c, g, or t
ccatgatcttgttttccnaaaacaagtttttcttntgaagantgggggntaaataacagggntgncttattgagtattcctcccngggtnaaaaaccaaaagaattccttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccaggtggcaggttgctgctctctccttcagaaccccgctctgaggaaagctaaggaagagaacaggacgtctgagtgtgtgactgagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaag

SEQ ID NO: 318506 - DNA, 3851 bp, Homo sapiens
  misc_feature (18)..(18): n is a, c, g, or t
  misc_feature (35)..(35): n is a, c, g, or t
  misc_feature (42)..(42): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (85)..(85): n is a, c, g, or t
  misc_feature (90)..(90): n is a, c, g, or t
ccatgatcttgttttccnaaaacaagtttttcttntgaagantgggggntaaataacagggntgncttattgagtattcctcccngggtnaaaaaccaaaagaattccttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318507 - DNA, 1672 bp, Homo sapiens
ctcagggtatctctagtgactgtggtatctctctgttaagagaagggtctgatcaaccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaag

SEQ ID NO: 318508 - DNA, 1262 bp, Homo sapiens
aggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtctttcctct

SEQ ID NO: 318509 - DNA, 362 bp, Homo sapiens
gatgtgatgtttagaaatatgtacttttattaggaagctctgcattctgcaaatatcaagcagaggtagaccccatccttactgaaggtcattttatatcatttcagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgaggg

SEQ ID NO: 318510 - DNA, 284 bp, Homo sapiens
tcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacagtaagttaaaatcttttccaagttttgttttgtggaaacggcttaaaaattattgttagttttatttttcttagattctggagttcttttaagtgcgtgacta

SEQ ID NO: 318511 - DNA, 748 bp, Homo sapiens
aggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccgtaagcaccctctgaatgtctgttcctctctacatgtttggctttcacttcctg

SEQ ID NO: 318512 - DNA, 6473 bp, Homo sapiens
agaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttggttctcagatttgtaggtgcataggtgtgtgtttcaaggaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318513 - DNA, 5660 bp, Homo sapiens
tggagttggatgtgtgagtgtgcccagagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaaggcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttggttctcagatttgtaggtgcataggtgtgtgtttcaaggaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318514 - DNA, 3983 bp, Homo sapiens
  misc_feature (18)..(18): n is a, c, g, or t
  misc_feature (35)..(35): n is a, c, g, or t
  misc_feature (42)..(42): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (85)..(85): n is a, c, g, or t
  misc_feature (90)..(90): n is a, c, g, or t
ccatgatcttgttttccnaaaacaagtttttcttntgaagantgggggntaaataacagggntgncttattgagtattcctcccngggtnaaaaaccaaaagaattccttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaag

SEQ ID NO: 318515 - DNA, 3148 bp, Homo sapiens
  misc_feature (18)..(18): n is a, c, g, or t
  misc_feature (35)..(35): n is a, c, g, or t
  misc_feature (42)..(42): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (85)..(85): n is a, c, g, or t
  misc_feature (90)..(90): n is a, c, g, or t
ccatgatcttgttttccnaaaacaagtttttcttntgaagantgggggntaaataacagggntgncttattgagtattcctcccngggtnaaaaaccaaaagaattccttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattaca

SEQ ID NO: 318516 - DNA, 2957 bp, Homo sapiens
tggagttggatgtgtgagtgtgcccagagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaag

SEQ ID NO: 318517 - DNA, 4155 bp, Homo sapiens
  misc_feature (18)..(18): n is a, c, g, or t
  misc_feature (35)..(35): n is a, c, g, or t
  misc_feature (42)..(42): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (85)..(85): n is a, c, g, or t
  misc_feature (90)..(90): n is a, c, g, or t
ccatgatcttgttttccnaaaacaagtttttcttntgaagantgggggntaaataacagggntgncttattgagtattcctcccngggtnaaaaaccaaaagaattccttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccaggtggcaggttgctgctctctccttcagaaccccgctctgaggaaagctaaggaagagaacaggacgtctgagtgtgtgactgagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaactccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtgt

SEQ ID NO: 318518 - DNA, 2971 bp, Homo sapiens
  misc_feature (18)..(18): n is a, c, g, or t
  misc_feature (35)..(35): n is a, c, g, or t
  misc_feature (42)..(42): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (85)..(85): n is a, c, g, or t
  misc_feature (90)..(90): n is a, c, g, or t
ccatgatcttgttttccnaaaacaagtttttcttntgaagantgggggntaaataacagggntgncttattgagtattcctcccngggtnaaaaaccaaaagaattccttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccaggtggcaggttgctgctctctccttcagaaccccgctctgaggaaagctaaggaagagaacaggacgtctgagtgtgtgactgagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttggtctcgaatgtggggaaggtggtgtcgaaggacgtgttaaacaggcacccaataattgtaaataacagttaaagaaaagtacaataattagttttatatctcggactcattttgtcgttgctgccacccatcatttctttctcatgtcggacaacacgaagagggggg

SEQ ID NO: 318519 - DNA, 3346 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaata

SEQ ID NO: 318520 - DNA, 679 bp, Homo sapiens
ccaccccgcaattatacccgcgcgcgccgcatgcagtcacagcaaaccacccccagggactcggcatcaccaggtgggggcgccagcgcaggatccttcacgcgacgcagcaaaactgggcagaggggtgggtggagatcggccgctctccacccacccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtacgtggccgccacaagctcggcatcaggagaggcactggcagacctgggctgtgggactgggggcatgtgctctgttttggttagcccccactcctggtgggcgctgtccacacagcatccggtgt

SEQ ID NO: 318521 - DNA, 1132 bp, Homo sapiens
acccctgtgctcgtggggaggaatgcacagatgatgaagactctacagctctaaaaattatataattctgaaggcacaatagcaaggcatattttctggcactctatatggttttatctaaatcctttccaattggaaagtcttcatggcagtgctgaagaatgcaagccagatcgccccagagatatttgaacaccgtaggtagaaatggtattgttaagagctcgacaaatcatttaaaaggcttttttttcccccattaccaggggtttgctaatagcctttatttgatttataccatattagcaatttctgagttttctcttttgctgagcttgtgcttttgtataaatcttttctatttgcttctcatttatgatcccacattcctgtccagagagtggtgtttttaattttctcagatggaaagcaacttcctaagcaagtaggtgaattaatcacaaaagcccacagtgagggggaggtcgagcggctcagtcaaccctcagtcatccatcacccgtggtggagttttcccggctgctccggtattatctcaaaatggtggttctcttacctcatagtgtctccgagagagtgggagaatggactcaatgagatcacatgtctgtaaattgtaaatcattccacaaaggtagtatattattacttagcttacaggggttttggaactatcaaaaagttaaaggcttttttcagaattcctactcatcattgctggaaagactcccagtgcccttagcagtcactcagcagcatgtccacagtttccgtgtgatggctcactttaaactggcccacatccaaacaccagccagcctgtgtcttcctcctcccaccactgatggaggcttggggatgtcagttaaattcagtctcagctccaaaggtgattcagagatgaatcagtaactgctttaatgatattaacatctcagaatcaaaaagaaccaagtattgtagatggcttaaaggagaaaagtatatcccttcatataccttgtttattctttatcaaaacattccagaatcctaactctgaaaacattaaccaattgctgtcactgacaaatgggacctgaggcctgtaaatacaaggatagagtcctat

SEQ ID NO: 318522 - DNA, 769 bp, Homo sapiens
cctccacccctaagggtggcctgccccttttctctctggcattatgtgggcaacagaggctacagtagagctcttttaataaggattaaaggcaatcgttcccaacatttggctggaggccctgaatttaaatgagcagaaacagataggaaattatcaacaatttcctgattttccatttctggatttcctgttcctctgttgacaagaaatcaagaaaatttatagataggatgtcgcttgtgcttatatttgactgtccgagaacatttcttctaggtttctcctaacccgttgttgtctcctaacttgaatttcagtagaccactgcttagcactcaatatttaatgaatattattcttggttcattctaaatcatttttctagttggaaacagtaggggttatcccaaatgataccttctaattcttagaattcccctcatacctgtggatagatgtctgttcccctaaaactgctcttatcggaaccagttcaggacttttaactctaattttacattcattctttcagtccaggtattctacttgtgtaaccctcacgtcttctgtttgctagtatgtttctaagactttctatggcaggtgctcacaacctctttttcgtttcctgccccatcacaggaaggggaggaactctcccatctggtactgtggctcaccttgacatggctgcttggtggcagaacactgtatcctaatcccaaggaacagagcttgaaaattacccccccaacctctaccctta

SEQ ID NO: 318523 - DNA, 595 bp, Homo sapiens
  misc_feature (569)..(569): n is a, c, g, or t
acgctctctctgttggggtcctgaagtggctctagcttctctggggttggggctccaggtgtgaagtcaggcatagacccagaaggctctctgtgttcccaggggaaagggacaggcggctcccaggtaggctccaggagaagactgcggggaagctggtgggtggtgtgtgggtgctcatggctgccctgccctgcccaggccgagcaggagctccgcgtggcccagacagagtttgaccggcaagcagaagtgacccgtctcttgctggagggaatcagtagcactcacgtgaaccacctgcgctgcccccacagagagagcgtctagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagagggtgtgtgcaacaacaggaagaactgcattgcgagggcggntggacctccttgacactggatttttc

SEQ ID NO: 318524 - DNA, 6043 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318525 - DNA, 6010 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctc

SEQ ID NO: 318526 - DNA, 4982 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacaga

SEQ ID NO: 318527 - DNA, 4709 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagagcggcagggggttgtcaggaaggctcctggggaccctgcatctgttgaggtctgaagggggcgagggaaacatgcattctgaagccgagatagctggctgtgcgaagatctagaggagtgtggactggcctgggctcagattctagagtgcggactgggccaacaggaggggacacaggacacggtgctcgtgctggtcctggggaagagggaaatggagtcagtcactgcccgggcctctggcttgagcaacctggggagttcagcaggttcagtgtgggggccctgtaaatgttcagtttcatagattgatgtattgaagatttatggattcactttatggaactagaaattatagttcaagatttttgctgttcactttttaaattaactttaattaactttgttatgagacaccagaactctagctagagccccctgtgatcactactaagggtctgaaaagagtgacattttgcccaggaaaccagaagcaatgcttttccagtaacaccaacaagtaagtcaagactgtcatctgttggctgtcttgcttaggctaagacacatccctgataggccttgttagtgggggatggggtccagaaaccaagaaggtgtgaaagacattctttccctggagtaggagctgctgctgcagtgatccacagccagctgagggtccaggtgggaggcagggccgaggagagcccaggtaactgcatcacggcgatcaccagcagccggaaaggactgttgcacacttacctgatgtgaagtacaccctgatccttgctgatgggaagacaaatgaatcaagatccctgtcctctaaaaattcactgtccagttgaaatcacaggtagacctcctctaagtctgagcatttagagtccttcccagacagccgctgaccatagctactgtaagaaaccaacctgatggtttgatttttttccttcctttccctacccttgaggaggctcttaactgtattaaacaaaatggcagcaggtcatagaaaagaagatgttttcatagagaaaatagcttcctcccaggaaaagggtttcccccacaaaggctgtgtttttaagtccccaacataacaaagcaaaaccca

SEQ ID NO: 318528 - DNA, 5958 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318529 - DNA, 3652 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagaatgacatggcataagtgaggggtacgactgcagggagagagggcatcatgggaggggagcaacccccacagaggaggcggctatggaggagaccgaggaggttggctatggaggagatcgaggatggcggagagggag

SEQ ID NO: 318530 - DNA, 5161 bp, Homo sapiens
gctgtcaccttatcagaactcgactgtcagagaatgtgtttccaccatcctctcagacatggtcctgaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318531 - DNA, 4789 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccactt

SEQ ID NO: 318532 - DNA, 4739 bp, Homo sapiens
cgctcggtacccggtccatgaacagttgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318533 - DNA, 4652 bp, Homo sapiens
aagctgaaatagtagacaagttcaaggcaggcttagctaaattcacagatggacttaatgagggcttaggaagagcatctccaagggctgctctgaaagagggagtttagggtggaggagaaatcgtgttgagactggcgcatccggtatattcctgtgttcatcacacaaacaactggcaaacagaatgttcatcatatccccatcttcaagtctctgaggttttccataccaggaggaatgagcttggtctgacagtttctgcaagaacgctggaagtatgaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318534 - DNA, 4635 bp, Homo sapiens
ccaccccgcaattatacccgcgcgcgccgcatgcagtcacagcaaaccacccccagggactcggcatcaccaggtgggggcgccagcgcaggatccttcacgcgacgcagcaaaactgggcagaggggtgggtggagatcggccgctctccacccacccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318535 - DNA, 4033 bp, Homo sapiens
agacttagacacccggttattgtggcaagctgaagactccttgtcaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318536 - DNA, 4770 bp, Homo sapiens
gactatatattcctgtttagcaagttctagagttgtcagaaatgaatgatggtaacatagattgaacctcaaacatggcatctgaagtaagacagtttattagtacatcactcacgggtgtactctcttcatttctgttgcttcagagttcactttgccataaacgtcacaacttgatacctcccatatttcattgtaactgcctccttctgtgagccccatgtgttttgtttcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318537 - DNA, 1845 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagaactcaggaaggaagagtcctatctgcccatcctgaacaagccccgtgagctagggtggctttcttgaat

SEQ ID NO: 318538 - DNA, 1180 bp, Homo sapiens
aaaatgatcagcagaataataaggagacaaagaaaaggagtgaaagaaaaataggttgggtagtttggtgagatgagcatatccatagtgtttgttccttccaaattttgaatacgggcttcatagcaagctgttcactactaccaacaccttgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaata

SEQ ID NO: 318539 - DNA, 1528 bp, Homo sapiens
atccctgcccgatcttctctgaggctccttgctctctgctttgactgagtggctgagtttgccagttccttagcctgcgacacttttcttaactaaggtcatttctatagtgaactgctgaatgggtatgaatgtcatcactgtatcaaagtactttgtaaaggccgacatctgtgtggtagggtgacaaggtgtgaagtttaatgccttttaaaaatcttactggaaagacacccacctcttagtaaaggtgacagtcacggcagcagtgggagtcattgcaacagcttttgcatatggaatgatgtgtgcaggtgctgtgtggtgcattttatgcccatgatgtcatcccctccttatacaactctgaagaaggtggtatgattcttttctcacatacctaggacctgaggctcagggaagttaagtaatttgcctaatgtgatctcgctaagatttacacacacacaggtctgcctgtcccccaagaagctcttagtagcagctgtgcttgaactcgtggccatttctcctcggatgacctttagaaatggtttactggtgcggtgctgttttctctgagttcttattgggcaattcaggggcaagtctaaatgatgcctcttttcgagggaaaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaata

SEQ ID NO: 318540 - DNA, 764 bp, Homo sapiens
tagaggatccccggtgtttatcgatgccacagatcaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaata

SEQ ID NO: 318541 - DNA, 1077 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaagggaaggggaggaactctcccatctggtactgtggctcaccttgacatggctgcttggtggcagaacactgtatcctaatcccaaggaacagagcttgaaaattacccccccaacctctaccctta

SEQ ID NO: 318542 - DNA, 1278 bp, Homo sapiens
aagctgaaatagtagacaagttcaaggcaggcttagctaaattcacagatggacttaatgagggcttaggaagagcatctccaagggctgctctgaaagagggagtttagggtggaggagaaatcgtgttgagactggcgcatccggtatattcctgtgttcatcacacaaacaactggcaaacagaatgttcatcatatccccatcttcaagtctctgaggttttccataccaggaggaatgagcttggtctgacagtttctgcaagaacgctggaagtatgtaagtattgggtgggagtaaggggggatgtgatgtagaagtggtttcttcaaatgtttttatgcccttgccaaactcagaacttaaccatgataatgacattgtctggaggggtgtctaattttgctcaccatgagcagggaatggttgctgtgtaggagcaagtcctaattatagtgttacagaaactcttctcaagattagcagaggaaaacttaaaaccatcatgggttggggtatgcaaaggggaaattccttgtaggccttgttaatttcttaaaggaaaaaatgaattagtttaagtttctcacctttctcaggagaggccatgttggctgaaaatggtttgtctttgaacttcttatgattgtttgttcatctaaataaatttgacagctcttcatgaagccatgaactctcgggtttggaatgatttcgttagcagtcatttactccatatgccaccagcagcagccacatcactgctacaatcacgaccaccattgctaacatcaccatctccacaatcgccaccaccacctcctccacccaacatcatcaccatttctctcatgaccatcatcaccatatcactgccactgccgccaccgtcatcactacagccctcaccatcaccccactattgtaaccactgccatctccacagctactgccaccaccgtggccacaccagtatccacatcgctaccagcatcactgctaccatccccacccctatcattatccccaccaccaccatcacatcagcaaatgcttgagtgcctaaaatgtgtcagccactcatattctgatcctccctcttttctccatgaaggagtcatgcggcttgacagggtgctgtctcgccaggtggcatgttgcattatagggtagctttgattattacaaactccctccttgtacagagccaaactgcttgcatgcagttaccaactttgtatttctgcggttaaggtccttattttgtaggataac

SEQ ID NO: 318543 - DNA, 906 bp, Homo sapiens
catatctccactactgggtagtttcttcagcaagtcagagcctctgaggtctccccttgggcaacgctgtttacccctttcccttcctccatttgtttagccccctctcaaccccgaacacggatatatccgtgttcggggttggggtatgcaaaggggaaattccttgtaggccttgttaatttcttaaaggaaaaaatgaattagtttaagtttctcacctttctcaggagaggccatgttggctgaaaatggtttgtctttgaacttcttatgattgtttgttcatctaaataaatttgacagctcttcatgaagccatgaactctcgggtttggaatgatttcgttagcagtcatttactccatatgccaccagcagcagccacatcactgctacaatcacgaccaccattgctaacatcaccatctccacaatcgccaccaccacctcctccacccaacatcatcaccatttctctcatgaccatcatcaccatatcactgccactgccgccaccgtcatcactacagccctcaccatcaccccactattgtaaccactgccatctccacagctactgccaccaccgtggccacaccagtatccacatcgctaccagcatcactgctaccatccccacccctatcattatccccaccaccaccatcacatcagcaaatgcttgagtgcctaaaatgtgtcagccactcatattctgatcctccctcttttctccatgaaggagtcatgcggcttgacagggtgctgtctcgccaggtggcatgttgcattatagggtagctttgattattacaaactccctccttgtacagagccaaactgcttgcatgcagttaccaactttgtatttctgcggttaaggtccttattttgtaggataac

SEQ ID NO: 318544 - DNA, 267 bp, Homo sapiens
caggggcctctgctggctcctggtaagtgaccctgcctaaccctatgtttattgcaggggacctgtaagccaaacccccctcagaagcctctgcctgcagatcctctggccagaacaactcggctcactcatgccttggccaggaccccaggacaatgggagactgggctccgcctggcacccctcaggtttgtgtgacatgccatgcccatctctttctctctcaaactcttgtgggaccaaccacgactaatccaagccaggaca

SEQ ID NO: 318545 - DNA, 800 bp, Homo sapiens
  misc_feature (709)..(709): n is a, c, g, or t
  misc_feature (757)..(757): n is a, c, g, or t
  misc_feature (769)..(769): n is a, c, g, or t
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacggtactttactacatgaattncgggaatctattacatcattacactgtctgttaggatattttaataantttaacataatnacaatcaattcacaactaactcggtatgtat

SEQ ID NO: 318546 - DNA, 563 bp, Homo sapiens
gcgttggcactgtacggaatggatgtcgggatggaactgaatgtgcctcacttgacactgcatatctgagttttttgatatgcattgttcattgagaccaccagtgaacacctgggcagatgtggccagtgggtgccttcttgtgggcacaagaagggcagacaaagccattccatgccctgtgacttactgttctgggctctcctttctcaggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagaactcaggaaggaagagtcctatctgcccatcctgaacaagccccgtgagctagggtggctttcttgaat

SEQ ID NO: 318547 - DNA, 412 bp, Homo sapiens
tcggtctaccttgtctctgaaactcgtggcagacaaccgaggtttcagaggcaaggaaaagatctggaaaaagttaagcagcgattaatagagattgctaatcacgttgacaagttttacagaccactgaacattcggatcgtgttggtaggcttggggatgtcagttaaattcagtctcagctccaaaggtgattcagagatgaatcagtaactgctttaatgatattaacatctcagaatcaaaaagaaccaagtattgtagatggcttaaaggagaaaagtatatcccttcatataccttgtttattctttatcaaaacattccagaatcctaactctgaaaacattaaccaattgctgtcactgacaaatgggacctgaggcctgtaaatacaaggatagagtcctat

SEQ ID NO: 318548 - DNA, 6988 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagttgcgatcactccactgcactccagcctgggcgagagagcaagactccatctcaaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318549 - DNA, 3732 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataacaaaaaaaaacaaaaaaaaaaaaatttgtgggggggctgcgggccctgagaaaaagtttttaaaaccttcggtgggggggcggggcgcccagtagggatagagggagacactggggccataagccgtggtccccaaagggagaaaccccggcgccactgagacaagggcgctgtggggtttctcctcacccaatttaaaaaaaacgcgccgcgggtggggacaacccaccggaggcggttttcttgagcacaaattctcctaagagggggagcttttcggggggggccacaataagcgggggctttcttttctaacacggggaggggctccaggggagagcctccagaattctataatttacgccgggccggggggggggcagga

SEQ ID NO: 318550 - DNA, 3566 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcccccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacattaagcaagagcaagaccccaaagagcaagaccccaaagagcaagccccgagatcctctaga

SEQ ID NO: 318551 - DNA, 5147 bp, Homo sapiens
  misc_feature (41)..(42): n is a, c, g, or t
  misc_feature (49)..(51): n is a, c, g, or t
  misc_feature (53)..(53): n is a, c, g, or t
  misc_feature (55)..(55): n is a, c, g, or t
tggcgcctttactaagtacaccgctcttctcttacttgtgnngaacgcnnnananatcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318552 - DNA, 5412 bp, Homo sapiens
gattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318553 - DNA, 4672 bp, Homo sapiens
aagacaacgtaagcctcaccgacaagttagaaatgcagaatcagcttggtgtggtggctcacgcctgtaatctcagcactttgggaggctaaggtgggcagatcaattgaggcccggagttcgagaccagtctggccaacatgacgaaaccttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318554 - DNA, 4570 bp, Homo sapiens
cagggactcgtagacccagttggatcataaaaagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318555 - DNA, 4432 bp, Homo sapiens
tgccactcctccagagagaattctatggccacatctctaaattgcaatggccccatttctaggcttccagggggtcctggcgtcttagctgtggatctcccaatacctgcaggacacagggccacagaggctgggcctctaggagaagaagactgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtgctaaacctgcccctgggatctgctttgagagagtcaattctgcaggtgatccttatggcaactgtggcaaagtctcgaagagttcctttgccaaatgcgagatgagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaaatctgcctgaatcgtcaatgtcaaaatattagtgtctttggggttcacgagtgtgcaatgcagtgccacggcagaggggtgtgcaacaacaggaagaactgccactgcgaggcccactgggcacctcccttctgtgacaagtttggctttggaggaagcacagacagcggccccatccggcaagcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtgtgtgcgcccttcccggccaccccgtggcttccaaccctgtcaggctcacctcggccaccttggaaaaggcctgatgaggaagccgccagattcctacccaccgaaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggggacctgtaagccaaacccccctcagaagcctctgcctgcagatcctctggccagaacaactcggctcactcatgccttggccaggaccccaggacaatgggagactgggctccgcctggcacccctcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagagccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggcatttttatgccttcttaactttatgagaattctcaggctgaactataggccattgttcccaggcaaatcaatacatcaatgcatcctcaaaaaaaaaaaaaaaaaaaaaaaccggctaaaa

SEQ ID NO: 318556 - DNA, 1717 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagcatgtgcacggcagaccagtctgggggaattgtcatggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggtacccatttcccatggtgttcagcagttgcagcaggaaggacttggagaccagcctggagaaaggaatgggggtgtgcctgtttaacctgccggaagtcagggagtctttcgggggccagaagtgcgcctgggtgcgcacccaggcgcacttctagatcacaaaagaatcaggtatggatgcagtgtccgaactttctttgggaggttgtaatcatgctct

SEQ ID NO: 318557 - DNA, 1389 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggggtgagcttatggaaccaaggaagagctgatgaagttgtcagtgcctctgttcggagtggggacctctggatcccagtgaagagcttcgactccaagaatcatccagaagtgctgaatattcgactacaacgggaaagcaaagaactgatcataaatctggaaagaaatgaaggtctcattgccagcagtttcacggaaacccactatctgcaagacggtactgatgtctccctcgctcgaaattacacgggtcactgttactaccatggacatgtacggggatattctgattcagcagtcagtctcagcacgtgttctggtctcaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaaggcataaaagagagaccctcaaggcaactaagtatgtggagctggtgatcgtggcagacaaccgagagtttcagaggcaaggaaaagatctggaaaaagttaagcagcgattaatagagattgctaatcacgttgacaagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcagtggggtttatttccaagggaccaccatcggcatggccccaatcatgagccagtggtcacgtgctgcaccaatggggatttgtctgaatggtccatgcacaattcccccatgactggtctgccgtgcag

SEQ ID NO: 318558 - DNA, 1073 bp, Homo sapiens
aagctgaaatagtagacaagttcaaggcaggcttagctaaattcacagatggacttaatgagggcttaggaagagcatctccaagggctgctctgaaagagggagtttagggtggaggagaaatcgtgttgagactggcgcatccggtatattcctgtgttcatcacacaaacaactggcaaacagaatgttcatcatatccccatcttcaagtctctgaggttttccataccaggaggaatgagcttggtctgacagtttctgcaagaacgctggaagtatgtaagtattgggtgggagtaaggggggatgtgatgtagaagtggtttcttcaaatgtttttatgcccttgccaaactcagaacttaaccatgataatgacattgtctggaggggtgtctaattttgctcaccatgagcagggaatggttgctgtgtaggagcaagtcctaattatagtgttacagaaactcttctcaagattagcagaggaaaacttaaaaccatcatgggttggggtatgcaaaggggaaattccttgtaggccttgttaatttcttaaaggaaaaaatgaattagtttaagtttctcacctttctcaggagaggccatgttggctgaaaatggtttgtctttgaacttcttatgattgtttgttcatctaaataaatttgacagctcttcatgaagccatgaactctcgggtttggaatgatttcgttagcagtcatttactccatatgccaccagcagcagccacatcactgctacaatcacgaccaccattgctaacatcaccatctccacaatcgccaccaccacctcctccacccaacatcatcaccatttctctcatgaccatcatcaccatatcactgccactgccgccaccgtcatcactacagccctcaccatcaccccactattgtaaccactgccatctccacagctactgccaccaccgtggccacaccagtatccacatcgctaccagcatcactgctaccatccccacccctatcattatccccaccaccaccccgtcggtggagcgggatcctctagatctaacc

SEQ ID NO: 318559 - DNA, 789 bp, Homo sapiens
atagcaaatgtaaataggagctagataatataagaatcctaatagatacccaaaagactctgttggctgggtgtggtggctcatgcttgtaatcctagcatttcaggaggctgaggcaggagaatcatttgaacccaggtgtttgagaccaacctggctaacataaggagaccctgtctctataaaaaataaaaaattagccaggcatggtggcatgcgcacagctatggccctagctacttgggaggctgaggtggaaagatcagttgagtctggaggtcactacagtgagctgttattgtgccactgtattccagcctgggtgacggagcaagtaccttgtctcaaaaaaagaaaagactgttgaatgacttggttacttcctttattactgttgaagtacttgatggataaattgtagacagctaaaactttttctgggtcttcatggccagtgagtgaagaaagaaatgttactgtggtattcagtagattctgttggttctgaaaagggaggagggttacctgaagatgactgagtgcttgctctgaaagggctcacatggatccagaatgactcagagactaaaaagttaataaaaggaaagtattcctatttcattttagttaattaaaaattgagcttaaaaactttaaaaggaacagtgctgaattagtttttgaaaactttagccttttaaattctttttaggtcctaagttaaattgatcttgaaatgaagatatttcctgtttcttagataaaccagtgttttcgattcgtggtctg

SEQ ID NO: 318560 - DNA, 517 bp, Homo sapiens
tggagtggttttcccggttgcgcctcactcacgcccatttttccctcaccccccctaaaaaaaaaaaaaaaaaaaaaaaaagaaaagactgttgaatgacttggttacttcctttattactgttgaagtacttgatggataaattgtagacagctaaaactttttctgggtcttcatggccagtgagtgaagaaagaaatgttactgtggtattcagtagattctgttggttctgaaaagggaggagggttacctgaagatgactgagtgcttgctctgaaagggctcacatggatccagaatgactcagagactaaaaagttaataaaaggaaagtattcctatttcattttagttaattaaaaattgagcttaaaaactttaaaaggaacagtgctgaattagtttttgaaaactttagccttttaaattctttttaggtcctaagttaaattgatcttgaaatgaagatatttcctgtttcttagataaaccagtgttttcgattcgtggtctg

SEQ ID NO: 318561 - DNA, 423 bp, Homo sapiens
tgactttgtggcacctgaattgtattatgtatgagaaactgatatatttgcaagatagcaaatgtaaataggagctagataatataagaatcctaatagatacccaaaagactctgttggctgggtgtggtggctcatgcttgtaatcctagcatttcaggaggctgaggcaggagaatcatttgaacccaggtgtttgagaccaacctggctaacataaggagaccctgtctctataaaaaataaaaaattagccaggcatggtggcatgcgcacagctatggccctagctacttgggaggctgaggtggaaagatcagttgagtctggaggtcactacagtgagctgttattgtgccactgtattccagcctgggtgacggagcaagtaccttgtctcaaaaaaagaaaagactgttgaat

SEQ ID NO: 318562 - DNA, 397 bp, Homo sapiens
ataaaaaataaaaaattagccaggcatggtggcatgcgcacagctatggccctagctacttgggaggctgaggtggaaagatcagttgagtctggaggtcactacagtgagctgttattgtgccactgtattccagcctgggtgacggagcaagtaccttgtctcaaaaaaagaaaagactgttgaatgacttggttacttcctttattactgttgaagtacttgatggataaattgtagacagctaaaactttttctgggtcttcatggccagtgagtgaagaaagaaatgttactgtggtattcagtagattctgttggttctgaaaagggaggagggttacctgaagatgactgagtgcttgctctgaaagggctcacatggatccagaatgac

SEQ ID NO: 318563 - DNA, 979 bp, Homo sapiens
ataaatgtaagacatgtgggaaaggcttttattctcccacgtcatttcaaagacatgaaaaaactcacactgcagagaaaccctatgaatgcaagcaatgtggtaaagccttcagtagttccagttccttttggtaccatgaaaggactcacactggagagaaaccctatgagtgtaagcaatgtgggaaagccttcagatctgcctcaatccttcaaatgcatgctgggactcaccctgaagagaagccctacgagtgtaagcaatgtgggaaagccttcagatctgccccacaccttcgaatccatgggtagaactcacactggagagaaaccctatgagtgtaaggaatgtgggaaagccttcagatctgccaagaaccttcgaattcatgaaaggacacaaacacacgtaagaatgcactctgtagaaagaccttataaatgtaagatatgtgggaaaggcttttattctgccaagtcatttcaaatacatgaaaaatcttacactggagagaaaccctatgagtgtaagcaatgtgggaaagcctttatttctttcacttcttttcgataacatgaaaggactcacactggagagaaaccctatgagtgtaagcaatgtggaaaaaccttcagatctacctcacaccttcgaaaacatggtaggactcacactggatagaaaccaaagcaggtgaatcacctgaggtcaggagttcaagactggcctgatcaatatgatgaaacccctgtctctactaaaactacaaaaattggccaggcgtggtggcctgcttctgtaatcctagctagttgggaggctggcacaggagaatcgcttgaatctggggggcagaggttgcagtgagccaagattgtgccattgcactctagcctgggcaacaggagcaaaactccgtctcaaaaaaagtcgaccggccgcgaatttagtagtagtagtagtagtaggcggccgc

SEQ ID NO: 318564 - DNA, 604 bp, Homo sapiens
  misc_feature (160)..(160): n is a, c, g, or t
  misc_feature (248)..(248): n is a, c, g, or t
  misc_feature (473)..(473): n is a, c, g, or t
ttttttgccgcagccagatacgattcgagccggtacctgagaggggtgtttcccgcattagccaacatgtgacgggtgcctgtattccagctactcaggaggctgaggcaggagaatcgcttgacccgggaggtggaggttgcagtgagctgagatcgtnccactgcactccagcctggatgacagagcgagactccatctgaaagaaaagatagatgagaggtgggtggaggggtgtgagtgaccgnccgtcctgatgagattgctccttgcagaggaatgaaggtgatagaaaaccgggccatgaaggatgaggagaagatggagattcaggagatgcagctcaaagaggccaagcacattgcggaagaggctgaccgcaaatacgaggaggtgagtggggctggcagatggcgcagcagcaggaagtgggaggaaatgcatctgctgagatagggaggacgccggggccnacggaaggaagctctcggttaggtcagctgtcctcctgcgtgaacatatgtttgtccagagacaaccacttggctaggaaactatctcccacgatgccagtaagtgctgcggacgcttgtctaacgtaact

SEQ ID NO: 318565 - DNA, 512 bp, Homo sapiens
ctcccagaccccacctcagagttcactccccaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318566 - DNA, 578 bp, Homo sapiens
aatacctgcctacttaggaataaatgtacttaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318567 - DNA, 1797 bp, Homo sapiens
agcggactttccagcagctgtggccagcggtgccgacgtcaggccctcccccagcggtgctgacgtcggcggtccggccgggtgacctcatcgccccgacggcagccggcccggggggcggggagaggcgggggaagccccctcataggcaaaggcttggggggccggggcgcggctgtgcagctctcgccggagccgagcccagccgagcgtccgccgctgcccgtgcgcctctgcgcctccgcgccatggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318568 - DNA, 1797 bp, Homo sapiens
  misc_feature (35)..(35): n is a, c, g, or t
  misc_feature (291)..(291): n is a, c, g, or t
  misc_feature (294)..(294): n is a, c, g, or t
  misc_feature (299)..(300): n is a, c, g, or t
  misc_feature (305)..(305): n is a, c, g, or t
  misc_feature (315)..(315): n is a, c, g, or t
  misc_feature (320)..(320): n is a, c, g, or t
  misc_feature (325)..(325): n is a, c, g, or t
  misc_feature (330)..(330): n is a, c, g, or t
  misc_feature (377)..(377): n is a, c, g, or t
ccactatcgctagaaacctcaatcgctgtgcctgnaagtatggaaatgaagttgggccagtttttaatctctgctgccagagaggccctttctgctaatagataaaaactcttttgctcaacttagtaatgacttgtggtcttttggatatggcagacctgaattggactgaactccaccatattcctgctgagtgggtcattactggaatgagacatttgctcttcagagaacaactttatttttattttttcttgagatggagtctcactctgtcgaccaggctggagngcngtggnncgatntcggctcacngcagnctccnctccngggttcaagtgattcttctgcctcagcctcctgagcatgtggaactncaggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318569 - DNA, 1703 bp, Homo sapiens
ggcggcgtctagaggatcccagttccatttcacctgctgggattacaggcatgagcaccacgcttggcgatgctcatctttgctatggagtggtagatgtttttcccagacattttccgggaagatcatactgaaatttggtatgagtgtaaattccctatggcctggactcctgggtgggctttgacagggaagatcaggttaacagagggcaggacatgggggaggctcccactggtggctggcctgatacttcttaacatggctgcacctccgacctccccaggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318570 - DNA, 1324 bp, Homo sapiens
cgcgcctccgcgcctccgtgcctccgcgcctccgcgccacctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318571 - DNA, 1212 bp, Homo sapiens
gggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagagacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318572 - DNA, 1023 bp, Homo sapiens
actctgccccacagccacagcccctgactgccgcagcccccacagagcccgccgcgcaccccacgtccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggtgagttatacgctcagaagctcaagtacaaagctatcagcgaggaactggaccacgctctcaacgacatgacctctctctgagaggcagccaggtcgctgccctctgtccttctcacatggtgcctcctacggccctgtggctttctaggagctccgctggcctcc

SEQ ID NO: 318573 - DNA, 1743 bp, Homo sapiens
actctgccccacagccacagcccctgactgccgcagcccccacagagcccgccgcgcaccccacgtccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318574 - DNA, 2029 bp, Homo sapiens
  misc_feature (523)..(523): n is a, c, g, or t
  misc_feature (526)..(526): n is a, c, g, or t
  misc_feature (531)..(532): n is a, c, g, or t
  misc_feature (537)..(537): n is a, c, g, or t
  misc_feature (547)..(547): n is a, c, g, or t
  misc_feature (552)..(552): n is a, c, g, or t
  misc_feature (557)..(557): n is a, c, g, or t
  misc_feature (562)..(562): n is a, c, g, or t
  misc_feature (609)..(609): n is a, c, g, or t
gaaaatgacaaagcggggattccagcccagcacttgtggccctggagttcctggtttaatgcttcccatgtacttcctttcttgtaggtaaaaacaccttgaaaagccaataacactatggggtatgtcttccatgcctgcaaccaagttttctttccctttccatatctttttgtcctgccatctctcagccaggcggattgaaggatggaattccaacgaggctcccccgcctcgtcccaccttggtaattgcatggccaacatttaactgagggctccatagtcttgcatttatcttgccattcaggtgaatgggagcggaactcacaggacacaatgagccgggtcactgatggccttgctttctaagaatctcacagtgagccctagaactctctacgtggtaacactgtgtgcctttttcagagaagagcctatcttagatcttagcctaacgttgggtctattgtgttgctggagagaccagcactgacattcatctcaaagcacatggctggagngcngtggnncgatntcggctcacngcagnctccnctccngggttcaagtgattcttctgcctcagcctcctgagcatgtggaactncaggctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318575 - DNA, 1610 bp, Homo sapiens
actctgccccacagccacagcccctgactgccgcagcccccacagagcccgccgcgcaccccacgtccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttgttattgccatcttcgctttgctggaaatgtcaagcaaattatgaatacatgaccaaatattttgtatcggagaagctttgagcaccagttaaatctcattccttccctttttttttcaaatggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactataggagagaccagggaccatcacatgggtagggatttccatccagagccaataatggtctggtgggggccgagggtggctattgtgggaagtcataacccacagatagattaacttaagaatcctggcccttctccacactccaccatgcagaacaaacatcctctcaagcagtcaacgtacaacgcttgggaaatagtcataattacccacatatagtaattaatagatggtaagtaatagatccttgatgtgatgttcttttgcatatttccctggccggctttcaccggtggctttcgtctgtaaggaaaggtggcttttgcctgtaatcccaacactttgggaggccaggacagatcacttgaggtcagga

SEQ ID NO: 318576 - DNA, 1303 bp, Homo sapiens
actctgccccacagccacagcccctgactgccgcagcccccacagagcccgccgcgcaccccacgtccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggagcgtggtctgaactaaaatgtggtgacctggaagaagaactcaagaatgttactaaccatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataagcaaaacagaagagtcttgttccaacagaaactctggagctccgtgggtctttctcttctcttgtaagaagttccttttctcctggccattctcactctcctcgttatgtcacgccgaccatggacacgcgtaccatagtcactgcagatccgagatgataacagtagtcccccagtcatatctcacgcattccgagtctgtagtacatgaatggcaacagcattgacagctctattatcgtacccttaaatagcaataattccgtaagtaggacaggtatctatccatagtgaatcatactttgaaacgacggaggccacttggatccatgggagaatagtcagctccacacagtgcag

SEQ ID NO: 318577 - DNA, 1002 bp, Homo sapiens
  misc_feature (975)..(975): n is a, c, g, or t
  misc_feature (992)..(992): n is a, c, g, or t
actctgccccacagccacagcccctgactgccgcagcccccacagagcccgccgcgcaccccacgtccccacgccagcgcccagccatggaggccatcaagaagaaaatgcagatgctgaagttggacaaggagaatgccatcgaccgcgcggagcaggcggaggcggataagaaagccgctgaggacaagtgcaagcaggtggaggaggagctgacgcacctccagaagaaactaaaagggacagaggacgagctggataaatattccgaggacctgaaggacgcgcaggagaagctggagctcacggagaagaaggcctccgacgctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcgggtgtctgaactgtgagtggcagaacaggactgagcgaggctggctcgattcctggggcggagtgggaaggagctggctgtgttgggaattggctctgaccggggtctctgctcaagtggacgggcgtcaggggctcatggctcatcttttctcttggcttctgtgacaaagaggtggtgacttgttcttactgccatgggaagcactgcccacgtgttgaccctttctgcaaagatatgaggaaataggagtgagacaggaggcagcagggaagcccagaagtcccattttcccatagaggatatctcagggggctgtgccatcttaacagaacactgnacctgctcagaaggcangctcccccgg

SEQ ID NO: 318578 - DNA, 489 bp, Homo sapiens
tcaggaactgtcttttttatagctgtatccagtcagctagtgtggcacacagtaggtgcttaataaaaacatagctactttctaattgctctggcgctcacatggaagtggcttgaacagtagacgcatgggagagagctgttcctggcatcctgatggcctggtgtgcatctcgggtaattcatacagtatcttacgtttgccctctccttattaatgtcacccagccctacctattctaggcagctgcgttcactctggtgaaggggataagttctctgggaaccttcatttgctgagtcagtgtggccacctagggtttctgcttggatgtgttcctgacacatccgccccggtctccagccctgggtggacagctctgcgtaagtgttcccattgctcctaggaattcgctctagtctcagacccaacacattcatccatccatccatccatccatccatccatccatccattcaacaatctgtg

SEQ ID NO: 318579 - DNA, 415 bp, Homo sapiens
ccaacaacatggacagagagacacaaagaggcaacggggacagggggtggggaggatggctggaggaggaagtaggcccagcagagtagggaaagagacacgcctctgtaggatcctattttactaaacccacaaagaccagccatggaaagtgccaggagagttcccgtgccaagttaatcagtaactggaaactgggcatcttgagactctaaggccttacaaaggtggcaacagggattcacaagctcttcccacaaagtcatatgcccaaagggacaccttcagttcaacctaggaaggggcccaagctaacccaaacatctactttgctttgcttttggcctgagtgacatcacctctcatggggagttgtgtcactttgactctcactgccaagcgccctgcaccatta

SEQ ID NO: 318580 - DNA, 2631 bp, Homo sapiens
caggtgctccgctccagagttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgagggtgggagagaaaattagggggagaaaggacagagagagcaactaccatccatagccagatagattatcttacactgaactgatcaagtactttgaaaatgacttcgaaatttctcttggtgtccttcatacttgctgcactgagtctttcaaccaccttttctctccaaccagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattattgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgttaggcaaccacggttacgataatgcgttagcagatatgcatccaatatttttagcccatggtcctgccttcagaaagaatttctcaaaagaagccatgaactccacagatttgtacccactactatgccacctcctcaatatcaccgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatttgcagaaaccattaagcagttacatatttaggtatacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatgtattgcactttaaatttctctcctgatgggtactttaatttgaaatgcactttatgcacagttatgtcttataacttgattgaaaatgacaactttttgcacccatgtcacagaatacttgttacgcattgttcaaactgaaggaaatttctaataatcccgaataatgaacgtagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacagattcgttctaaatatattgtttctgtcataaaattattgtgatttcctgatgagtcatattactgtgattttcataataatgaagacaccatgaatatactttttttctatatagttcagcaatggcctgaatagaagcaaccaggcaccatctcagcaatgttttctcttgtttgtaattatttgctcctttgaaaattaaatcactattaattacattaaaaatcaaattggataaaaaaaaat

SEQ ID NO: 318581 - DNA, 1638 bp, Homo sapiens
caggtgctccgctccagagttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgaggattatcttacactgaactgatcaagtactttgaaaatgacttcgaaatttctcttggtgtccttcatacttgctgcactgagtctttcaaccaccttttctctccaaccagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattattgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgtgtgagtatgttacagtatttctttccattctgcattactttttgctaaaatacaacagtttaaatacataatacagcagtttattgattgatatttttactgtctgttacttgaatattaaggaactacaatgttttcgtacttatctaaaaatgctttttttagatattggtccttgatatgtaaaagatatatacaaaatgtccctttaggtagaattgggtttctatcatgtttattgattaaaagaaaagcagatgcctgaacaatggcatttgtagtgtgctcgtgactcatagtggcagatgtatacagatacatggtttctggttcttaaaacggtttttggccaggtgcggtggctctcgcctgtaatcccagcactttgggaggctgaggcgggtggatcacgaggtcaggagatcgagacca

SEQ ID NO: 318582 - DNA, 267 bp, Homo sapiens
ataaaatgcccttccttaattctataaggtgaacttacaacagaagattatttcctagtttcccctcccaaaattgttttccccaaggggaaaaagaattttttcttatgttcagctctctggtttttcacctccgtagcaagtctgttgcccatggctgatggtagctatgagtattttgttctgagtgcctctcctcccttctctttaggtaaatttgatgaagtctatgaagcactaactcacgctcatcctaatcttactgtt

SEQ ID NO: 318583 - DNA, 2569 bp, Homo sapiens
caggtgctccgctccagagttgagcgcaggtgagctcctgcgcgttccgggggcgttcctccagtcaccctcccgccgttacccgcggcgcgcccgagggagtctcctccagaccctccctcccgttgctccaaactaatacggactgaacggatcgctgcgaggattatcttacactgaactgatcaagtactttgaaaatgacttcgaaatttctcttggtgtccttcatacttgctgcactgagtctttcaaccaccttttctctccaaccagaccagcaaaaggttctactagtttcttttgatggattccgttgggattacttatataaagttccaacgccccattttcattatattatgaaatatggtgttcacgtgaagcaagttactaatgtttttattacaaaaacctaccctaaccattatactttggtaactggcctctttgcagagaatcatgggattgttgcaaatgatatgtttgatcctattcggaacaaatctttctccttggatcacatgaatatttatgattccaagttttgggaagaagcgacaccaatatggatcacaaaccagagggcaggacatactagtggtgcagccatgtggcccggaacagatgtaaaaatacataagcgctttcctactcattacatgccttacaatgagtcagtttcatttgaagatagagttgccaaaattattgaatggtttacgtcaaaagagcccataaatcttggtcttctctattgggaagaccctgatgacatgggccaccatttgggacctgacagtccgctcatggggcctgtcatttcagatattgacaagaagttaggatatctcatacaaatgctgaaaaaggcaaagttgtggaacactctgaacctaatcatcacaagtgatcatggaatgacgcagtgctctgaggaaaggttaatagaacttgaccagtacctggataaagaccactataccctgattgatcaatctccagtagcagccatcttgccaaaagaaggtaaatttgatgaagtctatgaagcactaactcacgctcatcctaatcttactgtttacaaaaaagaagacgttccagaaaggtggcattacaaatacaacagtcgaattcaaccaatcatagcagtggctgatgaagggtggcacattttacagaataagtcagatgactttctgttaggcaaccacggttacgataatgcgttagcagatatgcatccaatatttttagcccatggtcctgccttcagaaagaatttctcaaaagaagccatgaactccacagatttgtacccactactatgccacctcctcaatatcaccgccatgccacacaatggatcattctggaatgtccaggatctgctcaattcagcaatgccaagggtggtcccttatacacagagtactatactcctccctggtagtgttaaaccagcagaatatgaccaagaggggtcatacccttatttcataggggtctctcttggcagcattatagtgattgtattttttgtaattttcattaagcatttaattcacagtcaaatacctgccttacaagatatgcatgctgaaatagctcaaccattattacaagcctaatgttactttgaagtggatttgcatattgaagtggagattccataattatgtcagtgtttaaaggtttcaaattctgggaaaccagttccaaacatttgcagaaaccattaagcagttacatatttaggtatacacacacacacacacacacatacacacacacggaccaaaatacttacacctgcaaaggaataaagatgtgagagtatgtctccattgttcactgtagcatagggatagataagatcctgctttatttggacttggcgcagataatgtatatatttagcaactttgcactatgtaaagtaccttatgtattgcactttaaatttctctcctgatgggtactttaatttgaaatgcactttatgcacagttatgtcttataacttgattgaaaatgacaactttttgcacccatgtcacagaatacttgttacgcattgttcaaactgaaggaaatttctaataatcccgaataatgaacgtagaaatctatctccataaattgagagaagaagaaggtgataagtgttgaaaattaaatgtgataacctttgaaccttgaattttggagatgtattcccaacagcagaatgcaactgtgggcatttcttgtcttatttctttccagagaacgtggttttcatttatttttccctcaaaagagagtcaaatactgacagattcgttctaaatatattgtttctgtcataaaattattgtgatttcctgatgagtcatattactgtgattttcataataatgaagacaccatgaatatactttttttctatatagttcagcaatggcctgaatagaagcaaccaggcaccatctcagcaatgttttctcttgtttgtaattatttgctcctttgaaaattaaatcactattaattacattaaaaatcaaattggataaaaaaaaat

SEQ ID NO: 318584 - DNA, 965 bp, Homo sapiens
gccgtgattgtgccactgcactccagactgggtggcagagtgagaccctgtctcaaaaaagaaattgtgtgacttgagccctgaatctgtaggttaccagaccccagtagcagtgagcttcccctgcctatttctgtatctgctgtcctggtacttaagtcccgaaagggaaggcagagacttcagcatggtggcactgaggccctcgccagcccaggaggtgacaggagccagactggcggatggggtcctgtgtttgttgccacagtgagtcactggactccactgtaaagaggagcagtctcgtggtcccatcagccatttattcagtcatttatttctaccagcatccactcgaggacattttttctttttccttttttttttttttgaaacagagtctcgatctgtcgcccaggctggagtgcagtggcgcgatctcagctcactgcaacctctgcctcccaggttcaagcgattctcctgcctcagcctcccgagtagctgggactacaggcgcccgccaccaagcccagctaattttttgtattttttagtagacacggggtttcaccgtgttagccaggatggtctctatctcctgacctcatgatccacccgccttggcctcccaaagtgctgggattacaggcatgagccaccacacccggccttgatgacattttttctacagactataaatcctttataaactttaattttgttgctcaagttgtcctctctgtttggccatcgtgaccccttccaaatgggctcctgtgtgcacatgatatgtcccgggtcactttttttgttattgaggtgaaattcacataacataaaattaaccattttcaggtgtgcaatgcagtgctttaatacattcacactggtatgcagccactgcgcccagcctggaattggccattttaaagactattttattgacttacttattttagaca

SEQ ID NO: 318585 - DNA, 2067 bp, Homo sapiens
ctcactggggaaaggagagaccaagggctgcttcatgaaggctgtttctgagctgagctttgaacaatagcatgacgagggtaggtggaggtgggagtcagggaagaggactcacctctgctggagctgacagctgaggagtcatgggaagaaagggaggatagaacagaaggccatgaagtagtggcggatgagactggaaagctgagctggtgagagtgaggaagagccttcaagggagggtgtgactttattttctatggcgcaattcaggtaatgggagtctctccagatgcaacacatgttacagcacaactttaatatgattcgtttggcaatagtataaagattccctctctgccctgcaccagtggacagaaatttcaatgataaaaaaggatgaaaacctcaatatgtgacccatgggaaagatagagatggaatcatactcaggagagatgtgttaagctcaatgcacaacacagaaattaaaagcagtctctattttgatgttcattcttgaccaccttcacatccatttcagctattccaaactgtggcggttacctggataccttggaaggatccttcaccagccccaattacccaaagccgcatcctgagctggcttattgtgtgtggcacatacaagtggagaaagattacaagataaaactaaacttcaaagagattttaggccctcattctctagcctagaaatagacaaacagtgcaaatttgattttcttgccatctatgatggcccctccaccaactctggcctgattggacaagtctgtggccgtgtgactcccacctttcgaaattggtcatcaaactctctgactgtcggtgttgtcttacagattatgccaattcttaccgggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgtc

SEQ ID NO: 318586 - DNA, 1978 bp, Homo sapiens
tgccaaaatggagcttgtaagaaggctcatgccattgaccctcttaattctctcctgtttggcggagctgacaatggcggaggctgaaggcaatgcaagctgcacagtcagtctagggggtgccaatatggcagagacccacaaagccatgatcctgcaactcaatcccagtgagaactgcacctggacaatagaaagaccagaaaacaaaagcatcagaattatcttttcctatgtccagcttgatccagatggaagctgtgaaagtgaaaacattaaagtctttgacggaacctccagcaatgggcctctgctagggcaagtctgcagtaaaaacgactatgttcctgtatttgaatcatcatccagtacattgacgtttcaaatagttactgactcagcaagaattcaaagaactgtctttgtcttctactacttcttctctcctaacatctctattccaaactgtggcggttacctggataccttggaaggatccttcaccagccccaattacccaaagccgcatcctgagctggcttattgtgtgtggcacatacaagtggagaaagattacaagataaaactaaacttcaaagagattttaggccctcattctctagcctagaaatagacaaacagtgcaaatttgattttcttgccatctatgatggcccctccaccaactctggcctgattggacaagtctgtggccgtgtgactcccacctttcgaaattggtcatcaaactctctgactgtcggtgttgtcttacagattatgccaattcttaccgggggattttctgcttcctacacctcaatttatgcagaaaacatcaacactacatctttaacttgctcttctgacaggatgagagttattataagcaaatcctacctagaggcttttaactctaatgggaataacttgcaactaaaagacccaacttgcagaccaaaattatcaaatgttgtggaattttctgtccctcttaatggatgtggtacaatcagaaaggtagaagatcagtcaattacttacaccaatataatcaccttttctgcatcctcaacttctgaagtgatcacccgtcagaaacaactccagattattgtgaagtgtgaaatgggacataattctacagtggagataatatacataacagaagatgatgtaatacaaagtcaaaatgcactgggcaaatataacaccagcatggctctttttgaatccaattcatttgaaaagactatacttgaatcaccatattatgtggatttgaaccaaactctttttgttcaagttagtctgcacacctcagatccaaatttggtggtgtttcttgatacctgtagagcctctcccacctctgactttgcatctccaacctacgacctaatcaagagtggatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggatttcagcatgaaacacatgcggaagaaactccaaaccagcctttcaacagtgtgcatctgttttccttcatggttctagctctgaatgtggtgactgtagcgacaatcacagtgaggcattttgtaaatcaacgggcagactacaaataccagaagctgcagaactattaactaacaggtccaaccctaagtgagacatgtttctccaggatgccaaaggaaatgctacctcgtggctacacatattatgaataaatgaggaagggcctgaaagtgacacacaggcctgcatgtc

SEQ ID NO: 318587 - DNA, 490 bp, Homo sapiens
gatctttattttgttagataatctggaatatttgtcaataaagattgggtaaagtgaaaagagggtaaagtgaaaagttgatattctcatatttttgtaccatttttcatagtttgcttgaggggataggttataaccaatctggaaagcattcacagttgtcatgacaaacaaatacaatgaaggtgtagtgtgtattgaatagtcccctagcaaaatcagtggggcaaacctctgggatacaaggtggttgaagttaataaatcatactcaaaggcttccaggacagaaaaacaaaaatgggagattttaagtcagtaagggaaagcttcctcaaaaaaccctcgtgagagaaatgaagatagccacacctgactgagaaattaagtggaggtgaactttgaaatctgtaaataatccatgtgtatgtaattgagaattgacattgtgaccttatgataattggatagctatttttattttcaatgtg

SEQ ID NO: 318588 - DNA, 1876 bp, Homo sapiens
agtttcggaaccccagccagctcacctctgcgccgctgaacccgatccgagcctccggcaaaggtttttccctcctcccccggccgagggcttctgccgcccgggcacccccgccccgcggcgccccacattcccccagcccggggcccttggcgcgtgcgctccgtgcggctgtgctccgcgggactttgtttgtttcctcctcgtccctctttgttgggctgaacaccagcctcgtcaaagccccccactccggagggagttcggcttctccagcagggcggctgcagcgcgctgccccgaccccgcctgcggcccctcacgccgctagtgctcccaccccgccctcctggcaccccgcctgcgtccgttcgcccgaggaagccaaccgcgacttcattgatgcacccattccagtggtgtaacgggtgtttctgtggcctgggactggttagcaccaacaagtcctgctcgatgccacccatcagtttccaagaccttccgctcaacatctatatggtcatctttggcacaggcatctttgtcttcatgctcagccttatcttctgctgctattttatcagcaaactgcggaaccaggcacagagtgagcgatacggatataaggaggtggtgcttaaaggtgatgccaagaagttacaattatatgggcagacctgcgcagtctgtctggaagacttcaaggggaaggatgagttaggcgtgctcccgtgccaacacgcctttcaccgcaagtgtctggtgaaatggctggaagttcgctgtgtctgccccatgtgtaacaagcccattgctagtccctcagaggccacgcagaacattgggattctattggatgagctggtgtgagtgctgccgctacaccgagacctggagaagacctcttgcctcatggatgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatccattcagtctcttcctcagttaatctcggagcttcctattccatgttgaggtttgtgggcccctctagaggagggctagttctatacttaaattgattcccaggggcctttttttttttttttttttttttttttgatcaaaaggggtgtggggatgggggtgtctacggttaagcaacagatacctccttccctttgtaaatagtatttttatacttcatcctcgcctctcaggctttagatacgaaatctccagaatggaagggggtggggattttctgttcctccctggagtgggtgagggtgggagaaagttacatatttaaagaaaaataaatttaataacaagtttctctaacctacttttg

SEQ ID NO: 318589 - DNA, 1814 bp, Homo sapiens
tcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagtcagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcacatcccccacattggacagaatgtagattgaatccctgggggcacatccgtcagcagcacagcaacagtatttccctcggcttggggagggttgtgttgggaatgagcgcccagtgcccatggatgaagtgaaggaaatggccatggttttctcccaggtggaaggggagaccgggcagtaacggtgaaattctagctatttggtttctaacaatggcacgtcaacaaatttgaataatcaatacacactatattaatgt

SEQ ID NO: 318590 - DNA, 2891 bp, Homo sapiens
tcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagtcagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattacgttccattagctttcttccacttagcagcaaagacgttccttactgaccaccaaataaaccacagggtgtgtgcaagcatcaagagtgcccagtgaggagtgtttttctctgggactcagccaaccgccccacctgacacacagtggtctccggcctaggagcacaggacagatgctcaggtacaggcagaatcacagtgtggcctggccttgtgggggacaagagggcctctgccagggtccacccaccaggcccacactgtctccctctgacctggccttgtccccaatgccctggggctggccagctccagtggtccacgactccccctggcttcctgcagttcagccccctctgacctacccccactccctcacaatccctcgctcagcatcctcctcttcctctatttcctggagtcatgtgagatttctgtcctcagccctcaagttccctgccctgtcctccaggggcagccccagctgagacctccccgtgtgccctccccacccagtggctcttcaagctgctcagcagcccttgatgatggcacactggccggtcttttgtgcttcctgctgggtcacccattgctcccaaagcatgcggcccacttgctggccaagtgctccaggtggtcagcacctagacatgctcctcccccctccctccccacttcctgggggctcccttgggataacgtgcaccctttcctaggggataaagcactgaaggccccacgtcccccaccccttaagagtcccagcctgatctgtccagcaacccactgttatctgggagctcctgttggtggaagtgaccaggtgaggccagggccagcagcataagatgggcagtgcctatagcagaggggtgagtgggatagtcccaccccatgagctggaagccaggtgctgggagaaggtgatagctgagatcacctgatatgcagcccccacacagtcctataaccagcgcacctcacagccggcaagcccagagtggaggctgcagacctgggcccagaaccgcaggggaacctaagggtacaacttccaagggctccgtttctcc

SEQ ID NO: 318591 - DNA, 307 bp, Homo sapiens
  misc_feature (80)..(80): n is a, c, g, or t
tttttaatttaaaacttacaataaaaagaaaaaaacctatatgccaccaattctaatgcttgtaagctgaaaccatttanggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaatt

SEQ ID NO: 318592 - DNA, 2470 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttcaaaaaaaaaaaaaaaaaaaaaaaaaaaaaaaaaaaaaaaaaaaaaaaaaaaaaaaaaacacaaacaaaaaaataataaacaaaaagagaagagaaaacacaaaaaaacaaaaacaaaaaaaaaaaacattaaaagataaaaacaaaaagaaaacacaagaggagggaggccataaatataaaaacacctacgagaggagggggaaacataacacaagcaccgacggtattgtaaaaaacaggagacccccatatattcagtgtatcatgaaacataaaatccgctgcacgcttacaacaattgagcagttacaaactgaacggaacttaacaagtgctgacagcatgaagaacaaccactctcgggacggtggatgatacaggacccaaatccctaagaataatacttgtcggtattcttttttttcggtctttataggagaacctgctaattcgcaaagataatttcgacatttaaaaaaatac

SEQ ID NO: 318593 - DNA, 1741 bp, Homo sapiens
gtgtagcgtctccacccgggctccaatccccagcctcgcactcagcaccaggcagagttcagcctcccgccgcaagctcccttccgccgctcccggcgagcacgcagcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 318594 - DNA, 2018 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatggtgggccccctcctgctcccccgaaccgctcgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 318595 - DNA, 1837 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaagagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 318596 - DNA, 1869 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatggtgggccccctcctgctcccccgaaccgctcgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaagagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 318597 - DNA, 1943 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaagtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 318598 - DNA, 953 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggtcaagtgattcagatgaggaaatgactgcagtggcctaattgtcttcacttgaattgaaaataaataatttgagagcttcaaatt

SEQ ID NO: 318599 - DNA, 858 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaagagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaatt

SEQ ID NO: 318600 - DNA, 140 bp, Homo sapiens
gtaagtatcttttcatcatttgtattactcgttggtaaaaagcccctttatacttttatctttcaaacatatatcctttcacagtattgtctccctttcataaatatttattaagtgtgttctgtatgcagagggtgaaa

SEQ ID NO: 318601 - DNA, 1986 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 318602 - DNA, 1007 bp, Homo sapiens
gtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaatt

SEQ ID NO: 318603 - DNA, 1719 bp, Homo sapiens
gctggtcgattctagatggatcccagttctgacggagactttcgttaatttgagctgctccgtggccacgaggacgtcaccattgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatcccccaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactactataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 318604 - DNA, 524 bp, Homo sapiens
ttcagcaacccgtctgaacagatctggcgtcctggagaattctagaatgaaggggaagagaggcagggaagagctgggaaatacgcaaagcgcctttttctccactttcggagatgccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 318605 - DNA, 789 bp, Homo sapiens
ggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcaaaaaaaaaaaaaaaactcctccatctatctcctaccaccccctcactctacccaccaccacctcactccccctctctcactcctccaaacaatcacggcgcggtttttacaacgcgggaat

SEQ ID NO: 318606 - DNA, 481 bp, Homo sapiens
ttcagcaacccgtctgaacagatctggcgtcctggagaattctagaatgaaggggaagagaggcagggaagagctgggaaatacgcaaagcgcctttttctccactttcggagatggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcagatgcggcggaaacaaaatcccgggccgctattaatcggggcggggaaggaat

SEQ ID NO: 318607 - DNA, 491 bp, Homo sapiens
caccaggcgcacttctgcaggcctcaggacccacacgaactaacctcaaattaattcattggtctttctgctagacgatgccaagtgagattgagacttccctctaacctcttgctgtcactccatgtcatcctctgctctgagaagtgcgcctgggtgcgcacccaggcgcacttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 318608 - DNA, 543 bp, Homo sapiens
tcagtagtaccccatgttcacctgccgccctgtagttgctcaaggtgtctgaaaaggaaagcgtcctggggcagcaccacgattcgaggtcccagagtagcccagtatgacggcagaattggaatgaaaagataaatgactagaagtgcgcctgggtgcgcacccaggcgcacttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcagatgcggcggaaacaaaatcccgggccgctattaatcggggcggggaaggaat

SEQ ID NO: 318609 - DNA, 675 bp, Homo sapiens
  misc_feature (531)..(531): n is a, c, g, or t
ttcagcaacccgtctgaacagatctggcgtcctggagaattctagaatgaaggggaagagaggcagggaagagctgggaaatacgcaaagcgcctttttctccactttcggagatgccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcatccgctnattaaaaaaaatatataatttaatattattaaattatattaataaatattcctcgtgggggggcgccgggccccaattcgcccttaagtgagggggtttacaattcactggccggcggttaacaacgcggggccgggaaaaccc

SEQ ID NO: 318610 - DNA, 668 bp, Homo sapiens
ggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 318611 - DNA, 1016 bp, Homo sapiens
  misc_feature (816)..(816): n is a, c, g, or t
  misc_feature (1016)..(1016): n is a, c, g, or t
ggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagcaaaaaaaaaaaaaaaaaaaaaaaaaaaaaaaaaaaaaaaaaaaaaaaaaaataaaaaaaaaaaaattaaaatattaaaaataaaaaatattaataaaataaataaaatatttatttgtatatttttaataatattcacttatattattntatttaaaataattattacatttttttaaatcattattttttaaaaatctttgaatttccaaacataactccctttctaacatttccctttctctactattcttttatagtataaatcccctaacccttctcccacacacccattaattctccctaaattcctttacccatttaacaattatatttttttaaaaaatccn

SEQ ID NO: 318612 - DNA, 490 bp, Homo sapiens
tcagtagtaccccatgttcacctgccgccctgtagttgctcaaggtgtctgaaaaggaaagcgtcctggggcagcaccacgattcgaggtcccagagtagcccagtatgacggcagaattggaatgaaaagataaatgactagaagtgcgcctgggtgcgcacccaggcgcacttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 318613 - DNA, 452 bp, Homo sapiens
gaatgtcagataaaagttggccagctaaaccatcctcctcctcctcctcttcctcctcctggtcctcccacatatcatgggagtcatcttgactccactctgcagaagtgcgcctgggtgcgcacccaggcgcacttctggtggctcctgcacctgcgcggactcctgcaagtgcgagggatgcaaatgcacctcctgcaagaagagctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 318614 - DNA, 1819 bp, Homo sapiens
ggcagtgcgcgcacagcggcggcgagtgggtcgtgcacgcggatgcggggtgggagtgggggcgcacgcgcgggcgtgggcgagcgggccccggcagtgcacacacacggcaggggcgggcgacagatgcagtgcgtgcgccggagcccaagcgcacaaacggaaagagcgggcgcggtgcgcaggggcgggcgcccagcgggcttggcatgcgcgcccccgcccgaggctataaaagcatcgccacctgctgccactagccaagccgcgcgtccagttgcttggagaagcccgttcaccgcctccagctgctgctctcctcgacatggaccctgagacctgcccctgcccttctggtgagcccccgcccccgctcgcatcctgcgcactgcgcgcccttgtacctgcaaagaaacccacgccctgcgccttcgctcaaggacacttgggggaagggcccctgattccctattcttcacctcgtgaagggcgggcatgcctgtgtcgcggagaacagggagacttggcaccccatctcctcgtgacaggcgtggggacccgagttcgtccacattaacccttcctgtggcgtcgccctctctaggtggctcctgcacctgcgcggactcctgcaagtgcgagggatgcaaatgcacctcctgcaagaagagtgagtgcggggacccttcccctctgccgccgcccctctgctctgcggagtcggtgtctcaccacgcaggatgtggagagacagccaggccccgatcccgtggtttctgactcttgctggaatagaaccacccgggcagacattaaaatacagatgcccctgccccacacccaggaattgatggcctaggcgtgggacgagaggtttttgtaaatccccagaagactccagtggcagctgggattgaggactgccacactggtccaacctttcccgacccatccctcaaaaactccccaaaacctggggaagccattagtgaggctgcggctcagctctggagttccggtcccttggcctctctccggccttacggatcctctcagtttgatctcaaaatctccccagctcacggcagtgtaatatgcatagggagtaagaggtgggaggaaggctcccttcttccctaggtatgaaaccaggcacaggtccccaccgcctccccacggctttcctgggccccttacatctgcaccatatctgcccctcccaagtttatcctttgaggcccctttcaaggtcgtttaccctgtgatgctttctccttaaggcctagtacccacctaagctgggcttaagcccaccagcccccaggacttcctggcatccacccaaggggctctggtcatttcctgggtacctcactcctgtggaggtgcaggatgccactgccgcgacatagatgctgagtcaaagcaggtgtgagactaagaagggggctgcgactagccctggctgaatgaaccaggatgactccccacccagcacccttccctcccctttgatggggacgaattgggggagtgtgcatcagagagtggtcatcttccattttatctgcaggctgctgctcctgctgccctgcggagtgtgagaagtgtgccaaggactgtgtgtgcaaaggcggagaggcagctgaggcagaagcagagaagtgcagctgctgccagtgagaaggcacccctccgtgtggagcacgtggagatagtgccaggtggctcagtgccacctatgcctgtggtgaagtgtggctggtgtccccttcccctgctgaccttggaggaatgacaataaatcccatgaacagca

SEQ ID NO: 318615 - DNA, 556 bp, Homo sapiens
acatttgaagaaaacatcaaatatgaatgagatcaaaatgaacaatcaataaaaaagaacccagacaggacgaggaaatacaaacagtagagaaagtatcaaagaatatatcattggtgctttcaaagattaagagactgcatcaatggaagaaacacagacactggaaacagggaggggagtgcaatagaggatgagataaagcaccagaaaattaaaaataagataactgtaatttaaagtttagtacaactttggaagataaagtcaatgaaattctccagacagtagttttttaaaaaggattttaaaaaagagttagagaatcgatccagaaagttcaaaagcttatttcagaatgagtttccagaaggaagaatacagaaaatagtgaagaaaaaattaacattgtatggagaagtttcaacaactgaaggacgtgagtctccgaacataaagaatcaaaaggacctggaaaatatatatattttaaacccaggcacattatgaaattttagaataccaagagtaaaaagaaaatgctaagaacttccag

SEQ ID NO: 318616 - DNA, 410 bp, Homo sapiens
ttggcttagcagctaattggcagaggaagagaaaatcctgggaataaaactggctaggaagtaactgagggtactgcggggtgaggtggcctctggagagggaaaaagacaggcaagctgcctggaggaagcaaagagaaaaaagaaaaagtttatgcaaatcataggtccacctggctgcctcctttccactttcagtttctatatggctctctggaggtttctccagggcttctgcacaaaaattcacggtggcagcctagagctggtcaatttcctccagaggcttgactctaactgagaggagccaggatcactgaaaaagcaatagctaaatctagaatacagggttagggaaggaatcttaatgtctcagtggagataaacacacccaggggaatgccaggcca

SEQ ID NO: 318617 - DNA, 109 bp, Homo sapiens
ggcccactgctggataaaaggtgcagcacccactggccacttccacggtttacatcttgcttcaaggccttgtgcccgatcagctgagcccctgtgccaaccctcaggt

SEQ ID NO: 318618 - DNA, 2655 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctacca

SEQ ID NO: 318619 - DNA, 895 bp, Homo sapiens
ggctggggctagggctggggggagggggaaggcctggggcaggagcctctgagctctttccttctgtgaccacggacctgtcagtttccaaacagaaggtgtgcctcacttgtgtggattttgtcactgtgcatgtatgtatgggtttctggggcattggtcctggtgctctctccacatcctgcatcccgtaccctctgtctcatggcccaggcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggtaagcattccagggcagagctagggagagagggagcactccaaggagggagtgctcactccaggatggctggaggtgaaagggacatgcataggagggggctgggagagcatctgaaagaatggtctggaagaatgaaggtgattgtctaggaaggggcagaggagacagagcaccagcagggtccaggaagacagggagcactcaaacagaggctggcatagagggagcattctccagacagatggaaagagcactattgggaagagagctggaagcactttgaagaaggaggatggaggaacgtattctgtcat

SEQ ID NO: 318620 - DNA, 2134 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318621 - DNA, 1459 bp, Homo sapiens
ctccctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318622 - DNA, 1348 bp, Homo sapiens
gcagcgtctggggcaggggtctccgagtctgtccccaaccctcagctcactcaacaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318623 - DNA, 3196 bp, Homo sapiens
  misc_feature (3196)..(3196): n is a, c, g, or t
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccaaaaaaaacactgaaaacaacacaaaaaaaaacccggggacacaccaacttcggggggcgcacaaaaacggttacaaacagcgcccactcgcaacacaaggttccggaaccacctccctgtcaccacggggggaaaactgcgcgggaccccccaaaggaacaccacataatcgaaaacaccgggaaaccgggataagtaaccgcaacgaggcccacgacagtaacaccgcagacagacggggcataagacgacgacacaacacagacgagcagccacgatacagaaaacatcacgctgcacaacaagacacccaaaaccgggaacggagaagacaaaagaaacaacagatccaaacgaacggtgcaagaacgcaacacaaacgacatactcgcgcgaacaacgaaaaaataagcaacgaacaaaacgaacacaacacgcggaacaaatactgcacaaacaaaaaagacgacgagggatacagagaagacaatcacacagagccgtcgtcatctggcctccgatggactgcggccgactcagn

SEQ ID NO: 318624 - DNA, 2948 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggaatgtcagtgttcacctcagccacgccattcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaaaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctacca

SEQ ID NO: 318625 - DNA, 1350 bp, Homo sapiens
ctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318626 - DNA, 2208 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggatttccaaagcggagatgctgccaacgtcttgatatttgtcaacccagaacctggggccctaacgcggaccctcagagccagcatctccgcttggaa

SEQ ID NO: 318627 - DNA, 2115 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacttgcagccgacagcgtatgatatcactacacagatgaaacgcgaaagagtg

SEQ ID NO: 318628 - DNA, 1613 bp, Homo sapiens
  misc_feature (1613)..(1613): n is a, c, g, or t
ggctggggctagggctggggggagggggaaggcctggggcaggagcctctgagctctttccttctgtgaccacggacctgtcagtttccaaacagaaggtgtgcctcacttgtgtggattttgtcactgtgcatgtatgtatgggtttctggggcattggtcctggtgctctctccacatcctgcatcccgtaccctctgtctcatggcccaggcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccaaaaaaaacactgaaaacaacacaaaaaaaaacccggggacacaccaacttcggggggcgcacaaaaacggttacaaacagcgcccactcgcaacacaaggttccggaaccacctccctgtcaccacggggggaaaactgcgcgggaccccccaaaggaacaccacataatcgaaaacaccgggaaaccgggataagtaaccgcaacgaggcccacgacagtaacaccgcagacagacggggcataagacgacgacacaacacagacgagcagccacgatacagaaaacatcacgctgcacaacaagacacccaaaaccgggaacggagaagacaaaagaaacaacagatccaaacgaacggtgcaagaacgcaacacaaacgacatactcgcgcgaacaacgaaaaaataagcaacgaacaaaacgaacacaacacgcggaacaaatactgcacaaacaaaaaagacgacgagggatacagagaagacaatcacacagagccgtcgtcatctggcctccgatggactgcggccgactcagn

SEQ ID NO: 318629 - DNA, 943 bp, Homo sapiens
  misc_feature (807)..(807): n is a, c, g, or t
ctccctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcanctacaggagttcaattgggttgtgctataggccgcatgggacaggatggaagggaactctcgtggatcccagccatgattaaagagtgggagccaatttccgttggccgattctacgggcctatggtgttgttccc

SEQ ID NO: 318630 - DNA, 1370 bp, Homo sapiens
  misc_feature (1370)..(1370): n is a, c, g, or t
ccgcatagagacgatctcatacacttatgcgcatgcctctgaccgtcgcagcgttgaccctcactgtgccagtcgtgacttgcaaaatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccaaaaaaaacactgaaaacaacacaaaaaaaaacccggggacacaccaacttcggggggcgcacaaaaacggttacaaacagcgcccactcgcaacacaaggttccggaaccacctccctgtcaccacggggggaaaactgcgcgggaccccccaaaggaacaccacataatcgaaaacaccgggaaaccgggataagtaaccgcaacgaggcccacgacagtaacaccgcagacagacggggcataagacgacgacacaacacagacgagcagccacgatacagaaaacatcacgctgcacaacaagacacccaaaaccgggaacggagaagacaaaagaaacaacagatccaaacgaacggtgcaagaacgcaacacaaacgacatactcgcgcgaacaacgaaaaaataagcaacgaacaaaacgaacacaacacgcggaacaaatactgcacaaacaaaaaagacgacgagggatacagagaagacaatcacacagagccgtcgtcatctggcctccgatggactgcggccgactcagn

SEQ ID NO: 318631 - DNA, 347 bp, Homo sapiens
gctggtctcgaactcctgacctcaggtgatccacccgcttaggcctcccaaagcgctaggattataggtgtgagccaccacgcctggctgatttctgagactctgtgttttgcccctcttaggctacctggggtacaccagtggtctctctctgacctgcatgctgtttttccttgtttcggtgagtcacagagaagcggggagagagtttgggacattgggacatagcttcctccatgacctggcttccctgctgcccccatcctcaggtcatctacaagaagttccaacttggctgtgctataggccacaatgaaacagcaatggagagtgaagctctcgtggga

SEQ ID NO: 318632 - DNA, 638 bp, Homo sapiens
atgaactaaaaggatggatgcatggataatgcatggatggaaagatgaatggagaatggatggatggatggacaggtgcattaacggatggataaaggaatgggacgacggatggatggatggatggatggataaatggatggatggatgcacccatggatggatggatgcatggatgaatggatggatgggtaaatgaatgggaggatgggttgatggaagcgtcgcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggatttccaaagcggagatgctgccaacgtcttgatatttgtcaacccagaacctggggccctaacgcggaccctcagagccagcatctccgcttggaa

SEQ ID NO: 318633 - DNA, 860 bp, Homo sapiens
  misc_feature (724)..(724): n is a, c, g, or t
tggccacgcggtgagggtggagggaaggagagggggtggcgcgggggaccggggaatgaaagacacagatggcaagagagacagcgatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcanctacaggagttcaattgggttgtgctataggccgcatgggacaggatggaagggaactctcgtggatcccagccatgattaaagagtgggagccaatttccgttggccgattctacgggcctatggtgttgttccc

SEQ ID NO: 318634 - DNA, 1440 bp, Homo sapiens
tggccacgcggtgagggtggagggaaggagagggggtggcgcgggggaccggggaatgaaagacacagatggcaagagagacagcgtgagtctggggtctgggaggagaggctatcccttctccacgtggtcggctcatctgcgctggggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318635 - DNA, 1376 bp, Homo sapiens
tggccacgcggtgagggtggagggaaggagagggggtggcgcgggggaccggggaatgaaagacacagatggcaagagagacagcgatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318636 - DNA, 1424 bp, Homo sapiens
tttctgagatacctccttcccaaggagtaagcgcgggagggagctggggtttcttcagagacgctgtacctacaagacaggggctccaggctcgggtggggattgcagagacacccccaccccaggaaactcggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318637 - DNA, 1962 bp, Homo sapiens
gcctggaatagcctggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcagggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318638 - DNA, 1008 bp, Homo sapiens
gacaatctcataatcagcttgactgtttttgtcaaccctattgtgccgtttgtcactgtgaccacctgaatgacttctcaagctgaggttgtcagcttaactctcctgacttagggcagaaagctgcctgtccagctgtcttctgtgagtgtctgcctgacagtttcctttggctggcagctaggcactgtgtcttcctgtctctctagggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatctccgctttggaaagggatcctatagatcgacct

SEQ ID NO: 318639 - DNA, 1810 bp, Homo sapiens
  misc_feature (1810)..(1810): n is a, c, g, or t
caggctggtacccccggaggtatggatatcgtcgacccacggcgctccgagtggtctctctctgacctgcatgctgtttttccttgtttcggtcatctacaagaagttccaacttggctgtgctataggccacaatgaaacagcaatggagagtgaagctctcgtgggactccccagccaaggactcaacagcagctgtgaggcccagatgttcacagttgactcacagatgtcctacacagtgcccattatggcttttgcttttgtctgccaccctgaggtgctgcccatctatacggagctctgccggccctccaagcgcaggatgcaggccgtggccaacgtgtccattggggccatgttctgcatgtatgggctcacagcaacctttggatacctcaccttctacagcagtgtgaaggcggagatgctgcacatgtacagccagaaggacccgctcatcctctgtgtgcgcctggccgtgctgctcgcggtgaccctcactgtgccagtcgtgctgttccctatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcgggtccacctcagcccccagcctcatcttcatcctccccagcatcttctacctccgcattgtaccctctgaggtggagcctttcttatcctggcccaagatccaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccaaaaaaaacactgaaaacaacacaaaaaaaaacccggggacacaccaacttcggggggcgcacaaaaacggttacaaacagcgcccactcgcaacacaaggttccggaaccacctccctgtcaccacggggggaaaactgcgcgggaccccccaaaggaacaccacataatcgaaaacaccgggaaaccgggataagtaaccgcaacgaggcccacgacagtaacaccgcagacagacggggcataagacgacgacacaacacagacgagcagccacgatacagaaaacatcacgctgcacaacaagacacccaaaaccgggaacggagaagacaaaagaaacaacagatccaaacgaacggtgcaagaacgcaacacaaacgacatactcgcgcgaacaacgaaaaaataagcaacgaacaaaacgaacacaacacgcggaacaaatactgcacaaacaaaaaagacgacgagggatacagagaagacaatcacacagagccgtcgtcatctggcctccgatggactgcggccgactcagn

SEQ ID NO: 318640 - DNA, 821 bp, Homo sapiens
ctccctgcctccctctgggggcccccaagatctagggtcctctcgtgcctaggctgtctgcctgaggaaaaaaaaaaaagtaccgctccagagcaggagcctaggcagccgagagggtgcccgaacctgagtctgagttgcggccacttcaggagctgagaggagcaggatggaactgcaggatccaaagatgaatggagccctcccttcggatgctgtgggctacaggcaagaacgtgagggcttcctgcccagtcgtggtcctgctcctgggagcaagccggtccagttcatggatttcgaggggaagacatcgtttggaatgtcagtgttcaacctcagcaacgccatcatgggcagcggcatcctggggctggcctatgccatggcccacacgggggtcatcttcttcctggccctgctgctgtgcattgcgcttctgtcgtcctactccatccacctcctgctgacctgtgctggtattgcaggcatccgagcctatgagcagctgggacagagggcattcgggcctgcggggaaggtagtggtggccacagtcatctgtctgcacaatgttggggccatgtccagttacctgttcatcatcaaatctgagctccccctggttatcggcaccttcctgtacatggaccccgagggggactggttcttgaagggaaacctcctcatcatcatcgtcagtgtgttaatcatcctgcccctcgccctcatgaaacacttgggctacctggggtacaccagtggtctctctctgacctgcatgctgtttttccttgtttcggtgagtcacagagaagcgg

SEQ ID NO: 318641 - DNA, 619 bp, Homo sapiens
gcggtggtggctgggaccagttggggaagtgagaatggtaagaagtggcctgcccctggccttatgtggatgctggagctggaaggatttccaggaacacgggctgtgaggtgtgagtgagagcagtaccagatgcctccagggcattgtcctgagcagccagaaggatgtggagggaggctgctaaccaggatggggatggctttgtgggggccgagcaggagcttgggtacaggcatgttgagtgtgagctatctgaacatctacggagagacagaaggaacgtgggtatcaagagttcagttagtatgccggggcccacaataccgaatggaacacattgagggtattgaaagccccaaaactggataacgtttctgagagagtgagtgtaggtgggccaggactgagctctgtggccctcccacattaagatgtggaaaaaaggagataccagcaaaagagatggagaaggaggccaggcgcagtggctcacgcctgtaatgcagcactttgggaggccaaggcgggcagatcacttggggtcaggagtttgagaccagcctggccatccccgtctctactgaaaatacgaaaaatgagtcaggcgtggtggtgc

SEQ ID NO: 318642 - DNA, 917 bp, Homo sapiens
ggcgtgtgtccctctctttcggaaataatgatatcatccatgtgtaattaattatgtggggcccatgttggaagactgtgtagccagctcttggctgtcgaagcactgactacatggatttaacctgccattgacagtggcgccatttttctggtcctccagaggaacataaacctgtccattttactcatcttgaaggagttttggcaaaacatgtattagggcagaaaatgaaacctcactagagctccctttgcactggaaggctggaggaatttcgtggacttggaggctctgccctgtgctccacggccacaagcccttaagtgttgtctccacagcatttgcatttgctgtcctcaaagccccgctcctccctctcccgtcgctgtcctcaaagccccgctcctccctctcccgtcgctgtcctcaaagacccactcctccctctcccatacacgattttgagctatatccttaatatccaggttcctttgtgtttcctggtaatgggtagaagtgcaaggggatttcagctcccaagagacagggtttccccgtgcctaagaccccagggttgatgctactctgtcatcaagtggtgactgtgactcttccccccgcaacctcaggaggtttttttggacttcatcccagatcctgagctggagctggtcctgggatgcagagcgtgcctgtcctagtgaactgaagtgtctccaaaagggttcctgaaaacagaacaaagttgcccagccaggcacgcaggccagggcaggaaactggccttggggccacctccgctcaggatggggtggaggcaaacagacttgtgcgtcatccttcacaaagaaggttctctcagatatttggatttccttgaggagccctcaaagcaataaaataatatgtccttc

SEQ ID NO: 318643 - DNA, 549 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318644 - DNA, 730 bp, Homo sapiens
  misc_feature (92)..(92): n is a, c, g, or t
ccatctggcaccaacatagcgcatatgtgaggattcatctcggtctgccgtgacccttcatcccaccagtcacacgcagatggtttccttgncccgaaagatcagtgacatggacacaagtgtcattgaaggatgcaagatatgcagacccccaatacattctctccttcagccacctgaggtccgaggctgatgacctgttcttccttcttttcccggacgcgtgggcgagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318645 - DNA, 539 bp, Homo sapiens
aattcgcggccgcgtcgaccgagaagacgacagaaggggagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318646 - DNA, 941 bp, Homo sapiens
ctcccgcgggtttctcctcttctcgcgtgtatattgtgccccgccttggggcctccttacccgggcgaggcccttcttcttgggggcccgcggggtgtctccccctccgtcttccggggggcaactcctatagagcgctctggcgaccagagggcttattctgtcatccgggggaaccgggcgtggtgggccaccatcagttcccggctctcaccactggccctgtgcccgccaccagaaatcctgtctgtgattagggtcagccttgtcagtcactcgatggcgaagtgtaggcccctgggtgttgctggggtccgcccccggtcccgcccccgtctatctgccggcccatgataggtggtccccaggggaacttctcggctttccactctggaggtgatgcctccggccccccaacccggtgctggcccggctccccgagcagcttgttaggtaacccccatctttttcctccggcgtagtgaccctcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318647 - DNA, 699 bp, Homo sapiens
ggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctataagaagatactcagtaaaacagatcccaacactcacacgattctttacctttcacttcatcgttgcccttcaattattgcaggccctaaacaacagtccagctcctattgattgccgaaacgggatcaaagtaaggccctaggaatcactcacattcgatgagaacaactttccacccgttatacacaatgaaagaaggccacgggataatgtcattcca

SEQ ID NO: 318648 - DNA, 523 bp, Homo sapiens
atccgagctcggtacccctctcgagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318649 - DNA, 939 bp, Homo sapiens
  misc_feature (931)..(931): n is a, c, g, or t
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctataaaaaaaaaaaaaaaaaaaaaaaaaaacaaaaaaaaaaaaaaaaaaaaaaaaaaaaaaaggggggggggccaaaaaattcccccgggggggcccattttcgccccctctttttgtgtaactagagggccccccttatgggggcgcctcttacatatagcccagccacccggcccctgctttaacacacgttctggctgtgcgggaacaccggtccctcgtgcggcctcgtggggagggccccctcttccggggggtggcgcacttcatatggagcacaccccccaacgaaatttataggccccggggaaatattaacctgtccgctactagctgtgtacacccagccggatatctgtccggcggcaaattgtcacggatgtnttgaatgt

SEQ ID NO: 318650 - DNA, 724 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctataaaaaaaaaaaaaaaaaaaaaaaaaaacaaaaaaaaaaaaaaaaaaaaaaaaaaaaaaagatctttattattctcaacaccaatggccgcctgtctgttgacagaactcactcctctgtcctatgaagaccgctccattggtgttgagaataataaagctctgtgtttttttcta

SEQ ID NO: 318651 - DNA, 900 bp, Homo sapiens
  misc_feature (611)..(612): n is a, c, g, or t
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctatcaaaaaaaaaaaaaaaaaaaaaaaaaaaaaaataaaaaaaaaaaaaaaaagggggggggggnnaaaattttccctggggggcccaatgtttaggggatacccaggtttttttttggaaaagggggggcccaatgagggagagcaattaataaaaaaggcacgaggccgagtgttaaaccagggtctgcagggggaaaaagcggcgtacttggggaaatttggaaaggaacctatttttggtgggggacaactgcgcacacatcctagagaataacggtcaggggaaaatacattgaggtgtatgtgtgtaccacgcgatgtgtcgcgaaattggtacggatgttgaattaa

SEQ ID NO: 318652 - DNA, 697 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctatcaaaaaaaaaaaaaaaaaaaaaaaaaaaaaaagatctttattattctcaacaccaatggccgcctgtctgttgacagaactcactcctctgtcctatgaagaccgctccattggtgttgagaataataaagctctgtgtttttttcta

SEQ ID NO: 318653 - DNA, 515 bp, Homo sapiens
  misc_feature (14)..(14): n is a, c, g, or t
tattattttagtgngttctgtgttatttcttcgccgccccccccttccctcccgatcccccttcctttctgataccacccccaccccgtttgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318654 - DNA, 1030 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctattaaaaaaaaaaaaaaaaaggggggccgtcgggatctaaaactacgggaagataaatgaaatggcaccaaataggagcacctctggtacacaaagggatgctgggaccagaccctgtgtgacctgaatgagatgtagaaggccccagtcccaccctggtgtgtcctccctctgagccagactccgctgaggccagcctgggggaagctgacctttaactgagggctgatcttaactggaaggctgtttctcctttaaccaccccctccttcgctgtgtcttttcggcaaagtgtctctggctcttcccggagaattcaggtgggtaaaggctgagcccttgtggagcaacatttagggagtggagcccatgctaatgtcttaaaacgctgtggtgtgtacccttctgaataccttttgtgttgggcacacattgtaacatcaagaattccagtctgaagagaatgatccttcacctcggagg

SEQ ID NO: 318655 - DNA, 753 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctataaaaaaaaaacatcccaaatcaaattctattctttctctctcacctcaaactacaatttatctccataatatcaaaaaaacctttgtgccgtttgggccaagcgaattttagaattggcaggcttatcaatgggcccgaaattggggctaattggccaaattcccctaaggggagccgattacttatgggccgctttcggcggc

SEQ ID NO: 318656 - DNA, 623 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctataaaaaaaaaaaaaaaaaaaaaaaaaaaaaaacaaaaaaaaacaaaaaacaacacaaaaaaaaaaaaaaaaaaga

SEQ ID NO: 318657 - DNA, 769 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctataagaagatactcagtaaaacagatcccaacactcacacgattctttacctttcacttcatcgttgcccttcaattattgcaggccctaaacaacagtccagctcctattgattgccgaaacgggatcaaagtaaggccctaggaatcactcacattcgatgagaacaactttccacccgttatacacaatgaaagaaggccacgggataatgtcattcca

SEQ ID NO: 318658 - DNA, 536 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactaacaaacatcattcctttggacctataacaacaacacatcctatttctacgcgcca

SEQ ID NO: 318659 - DNA, 548 bp, Homo sapiens
  misc_feature (412)..(412): n is a, c, g, or t
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcgggggggnaaaacccctttttttcccccaaaaagggggtttttccccccccggggccgcctgtctgttgacagaactcactcctctgtcctatgaagaccgctccattggtgttgagaataataaagctctgtgtttttttcta

SEQ ID NO: 318660 - DNA, 885 bp, Homo sapiens
aattcgcggccgcgtcgaccgagaagacgacagaaggggagcagcaacgcggaggaaacgggagtgaacggagagcgtagtgaccatcatgttttagcacaaccccctcagaccactctgtggagaacagactgtcagggaacgtgggtggaggcagagagaccagaaagattccaggacagagatgacagaggcttaggccatggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctatagtacaaaaaaaagaaaagaaaaaaagaagaatttgtggggggttttggcctggaaaagtttttaagaacaatggttggcgagcgggggccccagatgtgataaaaacccgtggaaagagggtgcactacagagaaacccgtgacgagaaaaggcgcgggaattccccaaataaaaggccgcgggaacaagggtttcaaacaaatcgaagggacgagggcacaggggctaa

SEQ ID NO: 318661 - DNA, 383 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaaaggcctataacaatcttatattggatggtcgactgagatctgagatttacaccggggaataaatttaaacctatagacgtacagactgattacttcctttatactcttcttctcttccaaagaaaagcaggaatccccaatgaagaaagtatattggggggt

SEQ ID NO: 318662 - DNA, 517 bp, Homo sapiens
  misc_feature (14)..(14): n is a, c, g, or t
  misc_feature (53)..(53): n is a, c, g, or t
cctagttttagaantttcaatagcaacgccgaggaaacgggagtgaacagagngcgtagttacatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318663 - DNA, 479 bp, Homo sapiens
ggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318664 - DNA, 619 bp, Homo sapiens
  misc_feature (619)..(619): n is a, c, g, or t
ggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcctagttttagaagtttcaatagcacccccaggcagcaatggttttaaccaatgacttaatttaacttagtgggtatactgttcccagtcccattactgatttttattcctctgtgataacatacacccaaataaagactgctatggaaacttctggctagagatttcaccgtttctacccccaaaataacgcttgctatcaagactttggagggggatgggggacaagaatttaagaggcagataatttttttttcataaaaagtaaaagtgctattgaaacttctaaaactaggaggtgctattgaaagttctaaaactaggtgctattgagagttctagaactaggcctgtatttccagctattcagaagctaatgaacttctaaactagggagagattn

SEQ ID NO: 318665 - DNA, 635 bp, Homo sapiens
aattcgcggccgcgtcgaccgagaagacgacagaaggggagcagcaacgcggaggaaacgggagtgaacggagagcgtagtgaccatcattagagaccaggtttcaccatgttggccaagctggtctcaaactcctgacctcaaatgatccacccgcctcgaccttccaaagtgctgggattacaggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318666 - DNA, 654 bp, Homo sapiens
aattcgcggccgcgtcgaccgagaagacgacagaaggggagcagcaacgcggaggaaacgggagtgaacggagagcgtagtgaccatcatgttttagcacaaccccctcagaccactctgtggagaacagactgtcagggaacgtgggtggaggcagagagaccagaaagattccaggacagagatgacagaggcttaggccatggagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318667 - DNA, 633 bp, Homo sapiens
  misc_feature (592)..(592): n is a, c, g, or t
  misc_feature (595)..(596): n is a, c, g, or t
  misc_feature (618)..(619): n is a, c, g, or t
  misc_feature (628)..(628): n is a, c, g, or t
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctatcaaaaaaaaaaaaaaaaaaaaaaaaaaaaaaacccggggcttnttnngggggggggaaaaaaggggttnnaaggggccnggggc

SEQ ID NO: 318668 - DNA, 741 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctataaaaaaaatccctcttcgacctctcctctctcctatacaatttgtggcccgctttgcccaagtcgacttttagactcgatcaagtttattgatggcgccgcaaattctgggtttacttgggccaatttgcccatatagggaggccgtttaacaattaagtggccgggcttttaacaacggcttgctttggga

SEQ ID NO: 318669 - DNA, 654 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctatagactcgagcaagcttttgcttggggccggaatttcgagctaatttggccaattccccctttaggggaggcgataacaattcactgggccggggtttccgggggg

SEQ ID NO: 318670 - DNA, 780 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctatagtacaaaaaaaagaaaagaaaaaaagaagaatttgtggggggttttggcctggaaaagtttttaagaacaatggttggcgagcgggggccccagatgtgataaaaacccgtggaaagagggtgcactacagagaaacccgtgacgagaaaaggcgcgggaattccccaaataaaaggccgcgggaacaagggtttcaaacaaatcgaagggacgagggcacaggggctaa

SEQ ID NO: 318671 - DNA, 644 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctatcataaaaaacaaaacaaacaaaaaaaaaaaaaaaaaaaaaaaaaaaaaaaaacaaaaaaaaacaaaaaacaacacaaaaaaaaaaaaaaaaaaga

SEQ ID NO: 318672 - DNA, 530 bp, Homo sapiens
ggaagtgggtcgcaggaagaggaagtcccgcctctctctcctcaggcagagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaacttcacccaagctatcactcctcacccaaactaggtgaccgagctcgatgta

SEQ ID NO: 318673 - DNA, 484 bp, Homo sapiens
atccgagctcggtacccctctcgagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctat

SEQ ID NO: 318674 - DNA, 419 bp, Homo sapiens
tggcagagttgctttggcagcttggtcatcccggcctagcacctgcacccttccccaagccatgctgctggagggggcgagcagcaggcagtagggggcactgtcagaggcacgcccctcacgcccagtgcctcccctccctgttccccaccaggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgttttttt

SEQ ID NO: 318675 - DNA, 1391 bp, Homo sapiens
  misc_feature (1)..(2): n is a, c, g, or t
  misc_feature (4)..(4): n is a, c, g, or t
  misc_feature (6)..(6): n is a, c, g, or t
  misc_feature (8)..(8): n is a, c, g, or t
  misc_feature (13)..(14): n is a, c, g, or t
nncncngnccttnngcctgcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggtgggcgctacgaggagtggggcaggaaggagggggagactcaaggctctcctggtcccatctcttccccgcagctattggaggctgggcaatgaagtgactgactgagcaattgattgatccattcagtcctcccttaatcaagtaatatttatgaggtgcccacttagtgccagccattggctaagcaatcagtgagcaaaaccggcacagcgctgcttcttaagataggctaccccaagcaaagaaggagtaatcacaaactgggagatatgttagtgtggagagaaattgagggctgtgagagagagaacgggggagggctgcttctgtggatagaaagtggttagggaaggcctctttgagaagtatttgtgaagggtttattatagcgcctcacacaaaataattcctgtgtaactggtggcggttcgaatagcagttgctattgtgttgtggttattactggaatccaacaaactgggttcttgttctctctctgccatttattaactgtgtgacttgggcagtaataatcataataataaccagcattaattgcacacttgccctttgtc

SEQ ID NO: 318676 - DNA, 292 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggtgaggcgggctcatctgctgaggtcagcagggcccc

SEQ ID NO: 318677 - DNA, 7378 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgtaatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318678 - DNA, 7474 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318679 - DNA, 6455 bp, Homo sapiens
ggaagacttgctcaaggcaggaaatggcagacctaaagctcagattctgttctcctgactccaagcccagtgctttcaccggtgtagcgtgcttccccttggcttcgtagtgtgtcttgggatcagcgcttacggaggtctcaacctctccgggtatttacgagttaagggggcgggtcacaagcgccccgccctctccctggagagtcagcccagccccagaaagctaattggtgcagggagaccacctgtcaggctgggaggcggggcctacagccaggctgccgactcaggtaagccttaaaggggacaaatatgattccacgtttaagaacgacagagtagggtgatatatttgttaaaactcagatcaggattctgtggcccaaggaagagttttagttttgcctcctgataagggatctgatgaatgtaaaaagtcatacagagctaattatgataatagctgcagtcattaagggcttgctacatgctagctaaacccttcaggtaaacacttcacatttattaccttcttttaatcttaataacagtcacttcggagaggctggttaggagcccaaggtcacaaaagttgatgtcaggtttaagttcaatccaggtctgtcttgacctcaaatttctataactctgaagatcccaggaaaggaattgggcggtggatctgaaagaagccagacagtggagccttcagcccagaggaggaagagagcagatgcccggggtttgcctcccaggggcagggtttccaagccagggccctcagcgctggccttgaactgccagtgtggggttggggattcctggggaaagggatctgcggtgaggtcccaatcccatatccatctgggggcggggaccctgaggcagctaccactcctccacgctgatcccagccttcccttcttccaagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318680 - DNA, 7890 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgcaaaaaaaaaacaaaaaaatccgaagagcccctgcgtagtctcgctttatggaaggggacaggaggtgggtgccaactgcgggggtgtaggagggcgtgggctgcggcccttctgtccgcactcagcggcagagagcgcacagacgctcagcacacccgggcccaccacgcagggtgcatcagtccgtgggccccggccgtcgggaccctgacccgtcccgaggtgacgcgacgcccgcgcgcttgctcccagaagcgcggcctaggctcggccagcaacagcgactcctgggagggtcctgcgccctcgggggtgccccaggcgccgaggctgcgcgcggggcgttccaccgccaggcccgcccggcagggggcgccgggaccgaccgctcacgcccggcgtgctgaggaggccgctgggcgggcgccgtggtcgggcttccgtaccccgcccgcccct

SEQ ID NO: 318681 - DNA, 3626 bp, Homo sapiens
agctgcacagaatctggagtcaaatggacgagtgattttctgcccccagtgcctcagttaccccatctgtgaaggtgaagacagtgatgataacgcgatagttcatctcaaaacacagccaaggtgcaggagtgtggggactaagagcaatgcctgccccatgataaatgttagtacatgggaatgggaaatagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318682 - DNA, 7061 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagaggaggaggaggaattcgcccaggaggaggaggaattcgcccaggaggagaggaattcgcccaggaggaggaggaattcgcccaggaggaggaggaattcgcccaggaggaggaggaattcgccc

SEQ ID NO: 318683 - DNA, 1867 bp, Homo sapiens
gtgtgggagagccaataaacttacggctaggtacgaggcctgggtgttgtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318684 - DNA, 1909 bp, Homo sapiens
gtgtgggagagccaataaacttacggctaggtacgaggcctgggtgttagtgagactctgtctcaaaagagaaaaaaaaagaaaagtaaccttcagagattcttagaagagttgctcattcacacccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318685 - DNA, 4880 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacg

SEQ ID NO: 318686 - DNA, 3860 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacg

SEQ ID NO: 318687 - DNA, 3031 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggtgggcgctacgaggagtggggcaggaaggagggggagactcaaggctctcctggtcccatctcttccccgcagctattggaggctgggcaatgaagtgactgactgagcaattgattgatccattcagtcctcccttaatcaagtaatatttatgaggtgcccacttagtgccagccattggctaagcaatcagtgagcaaaaccggcacagcgctgcttcttaagataggctaccccaagcaaagaaggagtaatcacaaactgggagatatgttagtgtggagagaaattgagggctgtgagagagagaacgggggagggctgcttctgtggatagaaagtggttagggaaggcctctttgagaagtatttgtgaagggtttattatagcgcctcacacaaaataattcctgtgtaactggtggcggttcgaatagcagttgctattgtgttgtggttattactggaatccaacaaactgggttcttgttctctctctgccatttattaactgtgtgacttgggcagtaataatcataataataaccagcattaattgcacacttgccctttgtc

SEQ ID NO: 318688 - DNA, 3149 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccaccctcctttagtttttttgctcttgtctcatctgctcagtgaggtccccctcatacagcagcctccatccctgtctccata

SEQ ID NO: 318689 - DNA, 949 bp, Homo sapiens
gtgtgggagagccaataaacttacggctaggtacgaggcctgggtgttagtgagactctgtctcaaaagagaaaaaaaaagaaaagtaaccttcagagattcttagaagagttgctcattcacacccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318690 - DNA, 2249 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacaggtatgtgaatatctgatcccctctcccctttcttcccaaaggtcggacacccatcacctgcatgtgaccccagaaagaatgggagagctttctggctgccccctccctctggccattgccctccctgcaaaaacaaacaggccgggtgtggtggctcacgcctgtaatcccagcactttgggaggccgaggcgggtggatcacctgagatcacgagtttgagaccagcctggccacatggtgaaacccgtctcttctaaattcaaaaagtagctgggcgtggtggtgggcgcctgt

SEQ ID NO: 318691 - DNA, 505 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtatcccatttctgactcctggctttagctctcgggactcctctctctcagcttggtctctctctcttcccttctcactgggcaacggccttggtcaaactccatcccagcattcttcttctctctggagacacggtctcgctctgccgcccaggtgggagtgcatgg

SEQ ID NO: 318692 - DNA, 321 bp, Homo sapiens
aacaagtccagaaagggcgtggggggaggatcttctagaagtttaaggtcaaagactcagacttcccgccctgtttgaagtgcttaattgtgtggttgaaggctggtgttgggcggttgggcagtcctgctgtagagtgagtgacccgtagactggggagcagcccccactgctggaactggctctagtcctttggagtcaccgccttcccccagttaccctgggaaaaagccactggctgacagctttgctcagcgactgtcctccccaccctcagcttgctatggcatcgttcaggtgccaacgggaccctggttctgc

SEQ ID NO: 318693 - DNA, 1142 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaaggtcagcggccccccgccgtgtcccctaccagttccctcccatctatgggttcctccaacgctctcttcatccggtgtaatttgattctgtccaacgagcactgaaagggaacttgggaggtgggtaggtacctaccagtgaaccacccttctgttgacagacacactcatgctctggcactcaggtgaaatagtaggctcccctgcagtagttctgccagagggtagaccttcgcagttacttcattcattcattcgctggacacattttattaagtgcctactatgtgccagacctggtgcaaggtagctggcacacgctgttcggtgctgatcaagacaggtgtgctgcccgctcaatggaacgcaagttcttgcatgcgaagactataaatatcagtaaaaaggcaaagtaaatgcaatttgtgataaatgctgtgaagaaaataagacactaaaataaagacctggtgggggcttactttagaccagatggtaaaggaaggagacatttaggctgagacctggggcgtgagaaggagccagcttccaggagggtaagggcccccaggttccaggcagaagaaagcctgggcagaggcacagaggtgggcataagctccctagtgagcaagacagacaaaggccttggcctttcagagctaaccatccaaggactgtgctacccagcatagtagccatcggccacacgtggctacataaattaatcaaaattaaaagcaggctgggtgtggtggctcacacctgtaatcccaga

SEQ ID NO: 318694 - DNA, 7432 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318695 - DNA, 6671 bp, Homo sapiens
caaggtacaatttttcaagaacccccattaacattttctcctataatcgctacagtcatctggtgaggccagtagggtgcgagttactctcccccattttattacaggtgggaaagctggaggggtcgggggtactcatcccaggacacagacagtggcagagctgagacaggaaaccaggcatccccattcgtggaccagagctctctcccgccagtacacgcgggagtgggagggagtgcggggatctggggtccagctgtaactgtttcccctctgtgcacagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318696 - DNA, 5858 bp, Homo sapiens
ccacctactacaggaccgccaagaaaagaagttcccaaaaccactcctagtgagcccaagaaaaagcagcctccaccaccagaatcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccatgtccatcaggattgagagtgtgtctagctcccgaccactttgtcttgacctactgaaaagttgggaactgaggggtgccttcattcccctttgttcactttctccagctcaacttgggacttgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318697 - DNA, 7441 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggtcatttcagccagctcctcccatcacagatgacagctccaagcctagaaggggctcagtgacagggccaggacaagccctcaggactgtggcctcctggcccttggttcccctgccccacaacatggtctccacatggctggctggctggctgtccctgtgtgtgtgtgacacacggtgtgagtgcagggctgtgcccggggtgggagggtgtctatgtggcactgactgtcttagctcagagctggtggatcctctccatggacaatgacactttaaggattgtcttggtttgtttttcctatttgtggggtattttccccctcaggctcctgggtctgctgctgcctcaaggtgtcctgaccttgaggctgatgaggggacccctgcctgtttcccccatactgagttctagggaggtgctcaccccagactcttaggaagggtctagagaaatgagaggagcccaagccaggggccagctccgagaaagggtaacctccacgcttctctctcccaaattggaaatgaagacaggttttcaaaggcacaggctccccctgccagcttctaggatcttccttggtgtgcaatgggccagttaggggtaggcagcttgcacccagttctcctttatctcaacttattttcctggggagaggtgcctagagggattgaggtaacttcaactgggaattccaaggaaggtgggcaagtagccttggctctctcccaccaatgaaggaggggagtgtgatataagggaggagtgtaaggagagtgagggagggaggtagagtgagggagaagggtgagatagtggaaggagggggggagtggagggtgaacagggagtggaaaggggaaattgggtggtgggactggagacctcacccctgctcccgtcccgccccctttctatcccaacctgtttccatgtagcagacccttcctagggagcagggaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318698 - DNA, 6472 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacgacagaaacgtagtgcagatatatttttgcctgtgctgctcaactgttttttttttctgatactgaaaataatattaatattcctgttgataagactttgtaagatgttagggagctgataatggaggggggtgggaatccttcaaaggcaatttcttaggcacttgcaagggcttgggggagggggaggcagttgtgatgacctcagaaatactcactttttattaatgctaaatatgttagaaagaaatgatagcattcagcattttattcttcttaatctattaagctgtgtaactccctgccccaaaccactgaaaagaaaagtaaccttcaggccaggcgcggtggctcacgcctgtaatcccaacactttgggaggctgaggcgggcggatcacttaaggtcaggagttcaagaccagcctggccaacatggtgaaaccccgtctctatcaaaaattagccgggcatggtggcacgtgcctgtaatcccagctacttgggaggctgaggcacgagaattgcttgaacccaggaggctgaggctgcagtgagccaagattgtgccactgcactccagcctgtgtgagagagtgagactctgtctcaaaagagaaaaaaaaagaaaagtaaccttcagagattcttagaagagttgctcattcacacccacgcccttgcccaaggctggcccacttagagcgaaacttaacttttgtctggatgggaagagaagtaagtctaccccgaggttgccatgttgaagagtgagaggtccaagtgattctgtgcattgaaaccaagacaccccacccagaacacttcttccctccctcagcccaaaccaaaggctggggttctcatctccaagtggctgttctccaactttcccaagccgcttgcattccccagactggactactgtggcggttaggttagatttgaagacggggcccaggctgggtatgaacgggtgcagccctcttctcctcttcccccccacatctctcatgagagaggtagtggcatttccttctcagggagcttcaatgggaaaggtctcgaaagcttcaggaggagcagaataccaacgcagggggatggctgtaacgatctcaccgtctcctaacctcagtcccttttttgagagtgaatggtggagggtgggaagggacccagatttgtagatctctttgtctgggggaggggaaggatgtggtttgcagagcggaagcagagtttggaaacgcatgagagcagagcttcgtgtgttcccaccctcagtgaggaggtgtgagtgggtgagcatgtggagttgggtgttcccaccctcagtgaggaggtgtgagtgggggtgcatatagaggcagtgcctgctgtggggtcacaactggtgcatgccagcgccaaagggacctgtctttaggggaagccacagattgcaaacccaggggctcctttttcattctttctaaaaccttgatatcctcagcccaaaggcgatgcccccctgccacctccaagcctggaattgtgcataacccggatcttgtatctttgtataacggatgttatttgtacgaagggcagttcgtaaacagcacttgttcttttaataaaagaatgttttgca

SEQ ID NO: 318699 - DNA, 4700 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtgttttctctggctggctctacctttagcctcccttctacccacatctttggaacccccatgggtgccgttaatcccctcctctcccaagctgagagcagccacacagagccagacctggaggactgcagcttccggtgtcgggggacctcccctcaggagagtctgtcttccatgtcccccatcagcagcctccccgcactcttcgaccagacagcctctgcaccctgtgggggcggccagttagacccggcggccccagggacgactaacatggagcagcttctggagaagcagggcgacggggaggccggcgtcaacatcgtggagatgctgaaggcgctgcacgcgctgcagaaggagaaccagcggctgcaagagcagatcctgagcctgacggccaaaaaggagcggctgcagattctcaacgtgcagctctctgtgcccttccctgccctgcctgctgccctgcctgccgccaacggccctgtccctgggccctatggcctgcctccccaagccggcagcagcgactccttgagcaccagcaagagccctccgggaaagagcagcctcggcctggacaactcgctgtccacttcttctgaggacccacactcaggctgcccgagccgcagcagctcgtcgctgtccttccacagcacgcccccaccgctgcccctcctccagcagagccctgccactctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacagccttacagagcagcagagacatctccttcagcagcaagagcagcagctccagcaactccagcagctcctggcctccccgcagctgaccccggaacaccagactgttgtctaccagatgatccagcagatccagcagaaacgggagctgcagcgcctgcagatggctgggggctcccagctgcccatggccagcctgctggcaggaagctccaccccgctgctgtctgcgggtacccctggcctgctgcccacagcgtctgctccacccctgctgcccgctggagccctagtggctccctcgcttggcaacaacacaagtctcatggccgcagcagctgcagctgcagcagtagcagcagcaggcggacctccagtcctcactgcccagaccaaccccttcctcagcctgtcgggagcagagggcagtggcggtggccccaaaggagggaccgctgacaaaggagcctcagccaaccaggaaaaaggctaaatccacccttacccctcctgacccccccaagtggagggaacagatcctggcctgaggggtcctagcctggagcaggcgcctgcgcccagaccctggagagccttgacccagagcctgtgctgaggtccagggagtgtggagagctcctggtgtcgaggactgagactgagaggggagccccctccatctggcccccttccctttccgcactgtccgctttgtgaggctcagaggaaggacagtctgcaagcccgcctaggaggtccatccccagcaaatgttttggaggtccccccagagagcagagtgggccatggcagaagtagggggttggttggacctgtcacatgaaatggatcagcacttgaatggggagaagtggagggagaggccctgggcctgtccctgcggggaaatcttttatggaagaagggctggacccactttacctgcagtttcttcccagctcgggcagatggcagaagggaccccttggactttttctcgccatccctccccccagcgcaggggcacaagctgagcttgtaaaagcccacagatgttgggggctggagaaggggcaggagagcatcacactcagccccagcctcctcaacctcttggggccccgtgatggggaggagagggcaggtgcggggaggctctggccttccttggtgccccgccctttgtttgcactattggacttaggagtgccgagggtggggagatggagctgcccgtctcagtgtgtgagtgtgtgtgtgcgtgcatgtgtgtgtgtgtgtgtgtgtgtgtgtgtgtctgtctgcctgtctctctcctcctggacccagggcagccaagggcagggataggcgcagtggtcagatgaagcagcgccagagaggggacctcccagctcttatttgcaccctccccacctcaccaactttggtccctctctgggggcatgaatggttaacaaacaccagagcagtactccaatattggagagtcgctgggggcacagggctttgaatcagggtagtatcctgccttccctcccctgaccccacatggtctcagggcccccttagggccccctaccccactgatagcttcctccttctctggcacaaggggagccccagggcttgggggagggcgtaaggtggggggaaatgccactgcttttagcaaaagcctccctcccagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacg

SEQ ID NO: 318700 - DNA, 1151 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaattagccagcttgcctcctgcaccccacccccaccaaccaggggagccactaagctgactaacaactgtcccctcacccaccagctatttccccagggtagagtgggcaattctcaccttcaaagagtccccgcctgcccaggcctttggcacagaggctgagtggacagtcaggagagaggcgagaggcaaggcgaagcctgtgtccctgtttcagttgcactggggttggagcccagggtaggggtttccagcttccccaggctccggccttgtcagtctctttgcatgtgtggatttttctgtgtgtgtttctgtttgggtttttgttgttgggttttttttttttttttaataaagaaaagaagatgtgtatatttttggcaacg

SEQ ID NO: 318701 - DNA, 2099 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcagtctcgtccctgcagagctcccctgacttctctgcattccccaagctggagcagccagaggaggacaagtactccaagcccacagcccccgccccttcagcccctccttctccctcagctcccgagccccccaaggctgacctttttgagcagaaggtggtcttctctggctttgggcccatcatgcgcttctccaccaccacctccagctcaggccgggcccgggcgccctcccctggggactataagtctccccacgtcacggggtctggggcctcggcaggcacccacaaacggatgcccgcactgagtgccacccctgtgcctgctgatgagacccctgagacaggcctgaaggagaagaagcacaaagccagcaagaggagccgccatgggccaggccgtcccaagggcagccggaacaaggagggcactgggggcccagctgccccatccttgcccagtgcccagctggctggctttaccgccactgctgcctcacccttctctggaggttccctggtcagctccggcctgggaggtctgtcctcccgaacctttgggccttctgggagcttgcccagcttgagcctggagtcccccttactaggggcaggcatctacaccagtaataaggaccccatctcccacagtggcgggatgctgcgggctgtctgcagcacccctctctcctccagcctcctggggcccccagggacctcggccctgccccgcctcagccgctccccgttcaccagcaccctcccctcctcttctgcttctatctccaccactcaggtcggacacccatcacctgcatgtgaccccagaaagaatgggagagctttctggctgccccctccctctggccattgccctccctgcaaaaacaaacaggccgggtgtggtggctcacgcctgtaatcccagcactttgggaggccgaggcgggtggatcacctgagatcacgagtttgagaccagcctggccacatggtgaaacccgtctcttctaaattcaaaaagtagctgggcgtggtggtgggcgcctgt

SEQ ID NO: 318702 - DNA, 1209 bp, Homo sapiens
ctcatgggagtatgaaggagatggtaggaggctgctgcgtatgttcggacgagaggggctgggccgagaacccgctggtctactgcgatgggcacgcgtgcagcgtggccgtccaccaagcttgctatggcatcgttcaggtgccaacgggaccctggttctgccggaaatgtgaatctcaggagcgagcagccagggtgaggtgtgagctgtgcccacacaaagacggggcattgaagaggactgataatggaggctgggcacacgtggtgtgtgccctctacatccccgaggtgcaatttgccaacgtgctcaccatggagcccatcgtgctgcagtacgtgcctcatgatcgcttcaacaagacctgttacatctgcgaggagcagggccgggagagcaaggcggcctcgggagcctgcatgacctgtaaccgccatggatgtcgacaagctttccacgtcacctgtgcccaaatggcaggcttgctgtgtgaggaagaagtgctggaggtggacaacgtcaagtactgcggctactgcaaataccacttcagcaagatgaagacatcccggcacagcagcgggggaggcggaggaggcgctggaggaggaggtggcagcatggggggaggtggcagtggtttcatctctgggaggagaagccggtcagcctcaccatccacgcagcaggagaagcaccccacccaccacgagaggggccagaagaagagtcgaaaggacaaagaacgccttaagcagaagcacaagaagcggcctgagtcgccccccagcatcctcaccccgcccgtggtccccactgctgacaaggtctcctcctcggcttcctcttcctcccaccacgaggccagcacgcaggagacctctgagagcagcagggagtcaaaggggaaaaagtcttccagccatagcctgagtcataaagggaagaaactgagcagtgggaaaggtgtgagcagttttacctccgcctcctcttcttcctcctcctcttcctcctcctctggggggcccttccagcctgcaggtgagtgtgggcatccgggaggaagctgggagccgggaaagccttttgtcctgagcttttctcgcagggactttgcatattgggtttgcatctcatttacttctccattggttcaggataaagactggggaatcccctcctcctccaacctgcctctatgtc

SEQ ID NO: 318703 - DNA, 1201 bp, Homo sapiens
gtcgtgaggcgggccttcgggctggctcgccgtcggctgccggggggttggcctgggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaacacaccaaaaaagaacacaagaacaaacaaacaagacagagacaacagaaaatacagaatggagaccccagaagacgacaaaaatgataaccagtgcactgaccagacagagtactatagtcgagaacgcggaaacataaggggggaggcgcggcaaaacacattcctgccggcggaccacactcaacacccccgcgtgacgaagcgggagacaccacgggggaaatcaacagagggggg

SEQ ID NO: 318704 - DNA, 1027 bp, Homo sapiens
gtcgtgaggcgggccttcgggctggctcgccgtcggctgccggggggttggcctgggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaagggtatctggaggaagaaatttctaagcaacaaagcattcaaggtttcatcagctgtcgtaactgg

SEQ ID NO: 318705 - DNA, 1528 bp, Homo sapiens
atagtgtactgttttgcttccctgaatgatgtactttaatttcacccatttttgagcttcatgtaaatggatgcttttcatatattttctgttatggcttgctttttttctcaacattatgtatttgtgagaatcatccatgttgtgcaccaagctgggtgccttcattttttaactgctatttagtattctatcttcatgattataccacatttatttgtccatgccactatcactggacatctgggtggtttccattgtgcattttcttcacctgcagaaaaggcataaataaatattttcctcacatgcttgttacaccaagcaaacaaagtagtaaacagaaaaatgccttgaaaatactatgtggacacaaatttgagttagttataatggttatagaaatcctcgtgccgaattcggcacgaggcagaggcagggaccactcggggtctggtgtcggcacagccatggcgggcgcgttggtgcggaaagcggcggactatgtccgaagcaaggatttccgggactacctcatgagtaggacaatcagagatgacttggttgtagtgtggaaaccagtagggaccttgggaagctgccaaaccctttctagctctgggctcagctgtaagaactgctgattcctacaggaacacttggacaatccaatacctaaatgttaaccatcaattaacccagtaaacctgcaagatggaaacgaagatttgttctcacgagtttcacgtgattatttaaatacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318706 - DNA, 1575 bp, Homo sapiens
aggataactaaaaggggtgtttagccaacaagatgtggttcctttcagatttgaaaatattatttccaaattctaaattaatgaaacaatttttcatctttaatgaacaaaagccacaagccttattttatttcagcctctaaaattaaattgattgtggctgctgtcaaacacagacgacttcactttggtatccttggatgagtgtagttgtggaatgaaaaactattggttcatttctttaatattaatataagtttttgctattatgtcaaaagtactttccaatcttaatttcttagtgtctggggtcctgggcattgatttccaagttattttatcttagaatagctcatatgagctgaaaaacaatttattctcttattaagcttctttcttcagaaaagtacccaatttagggtctgcattttaagaattattaacaaatatcttcataaaaatttgggaaaaggagtgtggatagatttaaacataaaaatatggagaatagttctaacagggtttgaattatagcaacaatggattgtgtaagaagtgaatcttatttttatttttaaatgttctaaataggacaatcagagatgacttggttgtagtgtggaaaccagtagggaccttgggaagctgccaaaccctttctagctctgggctcagctgtaagaactgctgattcctacaggaacacttggacaatccaatacctaaatgttaaccatcaattaacccagtaaacctgcaagatggaaacgaagatttgttctcacgagtttcacgtgattatttaaatacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318707 - DNA, 1541 bp, Homo sapiens
atagtgtactgttttgcttccctgaatgatgtactttaatttcacccatttttgagcttcatgtaaatggatgcttttcatatattttctgttatggcttgctttttttctcaacattatgtatttgtgagaatcatccatgttgtgcaccaagctgggtgccttcattttttaactgctatttagtattctatcttcatgattataccacatttatttgtccatgccactatcactggacatctgggtggtttccattgtgcattttcttcacctgcagaaaaggcataaataaatattttcctcacatgcttgttacaccaagcaaacaaagtagtaaacagaaaaatgccttgaaaatactatgtggacacaaatttgagttagttataatggttatagaaatcctcgtgccgaattcggcacgaggcagaggcagggaccactcggggtctggtgtcggcacagccatggcgggcgcgttggtgcggaaagcggcggactatgtccgaagcaaggatttccgggactacctcatgagtagaataactcttcaggctctgtttatagccctgggttcatgcatgataaagtagacagcaacaccaccatacagtgcagaggagtggcaagagagtaaacggaaaaggagatgaaaatagaccaagtggagaaaggcctggtcaaaaaaggaggaaaaggaagatcactatggaataatagagagttgaaaaatgaagtgacacccaataacaggacgggtaagaaaagaatacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318708 - DNA, 2263 bp, Homo sapiens
aggataactaaaaggggtgtttagccaacaagatgtggttcctttcagatttgaaaatattatttccaaattctaaattaatgaaacaatttttcatctttaatgaacaaaagccacaagccttattttatttcagcctctaaaattaaattgattgtggctgctgtcaaacacagacgacttcactttggtatccttggatgagtgtagttgtggaatgaaaaactattggttcatttctttaatattaatataagtttttgctattatgtcaaaagtactttccaatcttaatttcttagtgtctggggtcctgggcattgatttccaagttattttatcttagaatagctcatatgagctgaaaaacaatttattctcttattaagcttctttcttcagaaaagtacccaatttagggtctgcattttaagaattattaacaaatatcttcataaaaatttgggaaaaggagtgtggatagatttaaacataaaaatatggagaatagttctaacagggtttgaattatagcaacaatggattgtgtaagaagtgaatcttatttttatttttaaatgttctaaataggacaatcagagatgacttggttgtagtgtggaaaccagtagggaccttgggaagctgccaaaccctttctagctctgggctcagctgtaagaactgctgattcctacaggaacacttggacaatccaatacctaaatgttaaccatcaattaacccagtaaacctgcaagatggaaacgaagatttgttctcacgagtttcacgtgattatttaaatacgcacttctggggcccagtagccaactggggtcttcccattgctgccatcaatgatatgaaaaagtctccagagattatcagtgggcggatgacatttggtaagaatgcagatttggataattgggaggactttcaacatagtagagctcctgcttgcatttcaagattgtagcactagatgttacagtcactattagaaagtcacatacagaatgtgatggcatggaagagtgttacttctctatgtcagtaagaaacaagattaattagaaatatttatctaggaagtagtaacatcttatttgcctttcagatttagcacactgaactgaagactgtgtcatctgaatcattctaatagtcactttaatgatttatattgtgaacttttttgggggaaactgtcattaaactgacttgaaaccctgatatttgaacataaaactattgtggagggaataaataacaattctttcagataatgaatggattataagcaactccaggagacaaaaaaagtgtctagaacaaatttcagcctactcttgctcggaaatatgttccttaaatgtttaaataattaacaaaaatgcatagcagtacagtaaatttttttatgagcttcctattgatacaggcatttaagtaacaacttttatctgtcaaaggctttcgcagaagaggttcttttttgatcagggcaatggaactgttcatctctgtggtcctatcaaccctctcagttttctaagttattgattgtctttgctctgctatttttggcagccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318709 - DNA, 906 bp, Homo sapiens
gtcgtgaggcgggccttcgggctggctcgccgtcggctgccggggggttggcctgggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgaggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318710 - DNA, 406 bp, Homo sapiens
tttcaccatgttggtcaggctggtctcaaactcctgacctcatgatccgcctgcctcagcctcccaaagtactgggattacaggtgtgagccaccatgcccggcccatacttaaacttttaataacatcacttagccaggaatctcccaaggctactttaggtttagatttattccattgtccatttctgctttagccccacctatgaaagaagacacattcacaaccagtggtagagaaactgtggtttatatgcccctcttagaataactcttcaggctctgtttatagccctgggttcatgcatgataaagtagacagcaacaccaccatacagtgcagaggagtggcaagagagtaaacggaaaaggagatgaaaatagaccaagtggagaaaggcctggtc

SEQ ID NO: 318711 - DNA, 961 bp, Homo sapiens
gtcgtgaggcgggccttcgggctggctcgccgtcggctgccggggggttggcctgggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318712 - DNA, 1309 bp, Homo sapiens
atagtgtactgttttgcttccctgaatgatgtactttaatttcacccatttttgagcttcatgtaaatggatgcttttcatatattttctgttatggcttgctttttttctcaacattatgtatttgtgagaatcatccatgttgtgcaccaagctgggtgccttcattttttaactgctatttagtattctatcttcatgattataccacatttatttgtccatgccactatcactggacatctgggtggtttccattgtgcattttcttcacctgcagaaaaggcataaataaatattttcctcacatgcttgttacaccaagcaaacaaagtagtaaacagaaaaatgccttgaaaatactatgtggacacaaatttgagttagttataatggttatagaaatcctcgtgccgaattcggcacgaggcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318713 - DNA, 1007 bp, Homo sapiens
gtcgtgaggcgggccttcgggctggctcgccgtcggctgccggggggttggcctgggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaatatttgttaaatgagtatgattaaatatcttgctgcattccctagg

SEQ ID NO: 318714 - DNA, 1608 bp, Homo sapiens
gtcgtgaggcgggccttcgggctggctcgccgtcggctgccggggggttggcctgggtgtcattggctctgggaagcggcagcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgccctctgttgctattctttgacattcatgagatttgcctacaaggtacagcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaaacaaaaagacaaaaaaaaaagaaaaaaaaactatgtgttcgggcaccctgcgccccctggaaacgttccacacacaactgcataggccacaggggacacaaacgcaaaggcaaccgtgccaaacagtgcccacagaaacacgggccaagaaaagagcaagagaatacaccccacaaaacaacgcgccgcggaaacaccgagcctctctagaaaaacccagagggcatccagaagcacaaaggggaccatcacacggaccaccacacaaccggaaattacaaatagccgcagcccacggggggcacagcgcaagaacgaggaataatcaacaacaacaaacaacaaagcagaacacgagaagcaacaccacagagagcaaacgagcacgaccagaacacgaagcagcaacacacccagcagtacagagaaaccacaaacaacaaggcaaaagacaagcgggcaagcgcgaagcaacagcacacacacacacaaaagagcgacgagagaccagagccagactagacgtaccaacactacagggaacactacacagctacgacaccacacagaagacaaatcctactgacattacctaagcaacacgcccaccacacatatcaacactaacacaacacagagtcctagac

SEQ ID NO: 318715 - DNA, 1259 bp, Homo sapiens
atagtgtactgttttgcttccctgaatgatgtactttaatttcacccatttttgagcttcatgtaaatggatgcttttcatatattttctgttatggcttgctttttttctcaacattatgtatttgtgagaatcatccatgttgtgcaccaagctgggtgccttcattttttaactgctatttagtattctatcttcatgattataccacatttatttgtccatgccactatcactggacatctgggtggtttccattgtgcattttcttcacctgcagaaaaggcataaataaatattttcctcacatgcttgttacaccaagcaaacaaagtagtaaacagaaaaatgccttgaaaatactatgtggacacaaatttgagttagttataatggttatagaaatcctcgtgccgaattcggcacgaggcagaggcagggaccactcggggtctggtgtcggcacagccatggcgggcgcgttggtgcggaaagcggcggactatgtccgaagcaaggatttccgggactacctcatgagtacgcacttctggggcccagtagccaactggggtcttcccattgctgccatcaatgatatgaaaaagtctccagagattatcagtgggcggatgacatttgcctcggaactggcttctgtttgcatgccacgcaacaaatgaagtagcccagctcatccagggagggcggcttatcaaacacgagatgactaaaacggcatctgcataacaatggaaaaggaagaacaaggtcttgaagggacagcattgccagctgctgctgagtcacagatttcattataaatagcctccctaaggaaaatacactgaatgctatttttactaaccattctatttttatagaaatagctgagagtttctaaaccaactctctgctgccttacaagtattaaatattttacttctttccataaagagtagctcaaaatatgcaattaatttaatactttctgatgatggttttatctgcagtaatatgtatatcatctattagaatttacttaatgaaaaactgaagagaacaaaatttgtaaccactagcacttaagtactcctgattcttaacattgtctttaatgaccacaagacaaccaacagctggccacgtacttaaaattttgtccccactgtttaaaaatgttacctgtgtatttccatgcagtgtatatattgagatgctgtaacttaatggcaataaatgatttaaatatttgttaa

SEQ ID NO: 318716 - DNA, 602 bp, Homo sapiens
atagtgtactgttttgcttccctgaatgatgtactttaatttcacccatttttgagcttcatgtaaatggatgcttttcatatattttctgttatggcttgctttttttctcaacattatgtatttgtgagaatcatccatgttgtgcaccaagctgggtgccttcattttttaactgctatttagtattctatcttcatgattataccacatttatttgtccatgccactatcactggacatctgggtggtttccattgtgcattttcttcacctgcagaaaaggcataaataaatattttcctcacatgcttgttacaccaagcaaacaaagtagtaaacagaaaaatgccttgaaaatactatgtggacacaaatttgagttagttataatggttatagaaatcctcgtgccgaattcggcacgaggcagaggcagggaccactcggggtctggtgtcggcacagccatggcgggcgcgttggtgcggaaagcggcggactatgtccgaagcaaggatttccgggactacctcatgagccaccgcactcgggtctggtgtcgtcacagccatggcggcgcgttgtcgaaagcggcgact

SEQ ID NO: 318717 - DNA, 1549 bp, Homo sapiens
ggcacgaggccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgctggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactctt

SEQ ID NO: 318718 - DNA, 805 bp, Homo sapiens
ggcacgaggccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgctggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaaactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaccgaaatacgtctatataaagctttcagctgtattgtaatactttgattcgatagggctacaactcccctactgctaaccacatttcatggaatatggctacattgcatcttgcattaaatatctggagaaaattca

SEQ ID NO: 318719 - DNA, 1894 bp, Homo sapiens
ggcacgaggccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgctggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattcaagcctgtttttcattgtattgctttatatggtttaggctgggaggtagtcgttggtaatcaattttagattctaaggttaaccattaatgaaaaact

SEQ ID NO: 318720 - DNA, 711 bp, Homo sapiens
gttttcgacatttttgtcgcctttattaaaatttctcagcagttaaacaggccgctgatagacataaaggaattatttatatagcagattgcccaactcttgcattgtatcctaacctaggaccatgctgtgtccccatggctttcaagctgaagaaatgaaggtctaaagtgtgtcagacgtacctaaagaagagttcaaaagtgtagctgccatcctttccttagctatcagaggaagcagtcactccagaatgagacatacacaagcccaggttcatagactcaccctccataagctgtgttgctagattgaagtttttaatcaccagtgaagaattgattgtcataattttaggagactactgaagtttgccttgtttctttccctaggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggag

SEQ ID NO: 318721 - DNA, 1797 bp, Homo sapiens
ggcacgaggccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgctggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattca

SEQ ID NO: 318722 - DNA, 1802 bp, Homo sapiens
gaccatgctgtgtccccatggctttcaagctgaagaaatgaaggtctaaagtgtgtcagacgtacctaaagaagagttcaaaagtgtagctgccatcctttccttagctatcagaggaagcagtcactccagaatgagacatacacaagcccaggaaaggaataatgctgacagcatgtctgcacattccatgctctgtgaacgaatcgccatagccaaggaactgatcaagagagcagaatcactttctagatcaagaaaaggtggcatagaaggtggtgcaaagctgtgcagcaaattgaaggcagaattaaaattcttgcagaaagtagaagctgggaaagtagctattaaagagtctcatttacagagcactaacctaacacacctgagagccattgtggaatcagcagaaaacctggaagaagttgttagtgttcttcatgtctttggttatacagataccttaggagaaaagcaaacccttgtggtagatgtagttgcaaatggtggtcatacttgggtgaaagccattggccggaaggctgaagctcttcataacatctggctgggcaggggccaatatggtgacaaaagcatcattgagcaggctgaagacttcctccaggccagtcaccagcagccagtgcagtatagcaaccctcacatcatctttgcattttacaacagtgtctccagccccatggcagagaagctgaaagaaatgggcatatctgtgagaggagacatagtagcagtcaacgctctgttagatcaccctgaagagcttcaaccaagtgagagtgaatcagatgatgagggccctgaacttttgcaggtgaccagagttgaccgagaaaatatactagcaagtgttgcgtttccaacagaaattaaggtcgatgtgtgcaaaagagtaaatctggacattactactttaatcacatatgtatctgccctcagctatggaggctgccactttattttcaaagagaaagtgctcacagaacaagcagagcaagagaggaaagagcaggttctacctcagctggaggcctttatgaaggacaaggagttgtttgcttgtgaatctgctgtcaaggactttcagtctattttagataccttaggaggacctggggagagagagagggccactgtgttaattaagcgaattaatgtggtaccagaccagccttctgagcgtgccttgagactagtggccagttcaaaaattaatagccgctcattaacaatttttgggacgggagacaccctaaaagccatcacaatgactgctaatagtggttttgtcagagctgcaaacaaccagggtgttaaatttagtgtgtttatccatcagcccagagcacttactgagagtaaagaggctctagccacccccttaccaaaagactacacaactgacagtgaacactaaagataccctttaaatatttttgtggaagtaagttatttataccaaaggctgggtcttcccatctaaactggtgggaaaaaaggtctatagtaaaagtaaaactgagaactcttaaaccagtagagtttctttgtctctcatctaaagtatataacctcccaaagtagaaaaagcacaagagagaagcttatctatcaaactgtctgcattagtgcaattaagaaccgaaatacgtctatataaagctttcagctgtattgtaatactttgattcgatagggctacaactcccctactgctaaccacatttcatggaatatggctacattgcatcttgcattaaatatctggagaaaattca

SEQ ID NO: 318723 - DNA, 990 bp, Homo sapiens
agtggtcaaaactggcacaacacaggatttatactggagagcaacctcacaaatgtaatgaaagtggtaaggctttttatcaaatgtccttgtctttggggtcatgagaaaattcatacagaatctattaaaaatgtactaaacatggaaagacctttaagcaacagtgatgtgatgaaggtggtagttttttaaatgaactcccataagagtctacacaccatagaactcataccaggaatcacaaagtctctaaatttccaaagttaactggaaatattacaaactgcagaataattccaggccaaaatatgttaaattcataacatgatgtatatcaaaggaaaaaaggacatgttggaaatgacacattatcttcagtgtataaaatattcatttatgtgaagtttcttggaaaggctacactactattactggtttccgtctgatgtttgagatctgttgattttatgcttttcttacaggcctttcattatgatctttgggaaggaatcaataaaatgatagggcctacttcattaggtgtggttcattcctattcatgctccctggaagaacaagaatgctgaattttgaaatttaatattgtatgaattagcatcagggagaggtggagaaaaatacaaaactaaaagtcatgcttattgtgttcagtgtgcccttctccagagggccactggcttataggaaaggattgctgctctaccagttgaccaggagatggcacgccaggacattaagacactggagttttgtttcgttttttttttttttgatgagtatcgcaccactgctcgccagcctgggcaacagagtgagactctgcctcaaaaaaaaaccaaaccaaaccaaagaaccagaatagcatgtgcacatatacacagacgtttcacaactggcattatgttttgctactgttttatttacaatgtatcacaagttttatgctttaataaaatttaatcataa

SEQ ID NO: 318724 - DNA, 956 bp, Homo sapiens
agtggtcaaaactggcacaacacaggatttatactggagagcaacctcacaaatgtaatgaaagtggtaaggctttttatcaaatgtccttgtctttggggtcatgagaaaattcatacagaatctattaaaaatgtactaaacatggaaagacctttaagcaacagtgatgtgatgaaggtggtagttttttaaatgaactcccataagagtctacacaccatagaactcataccaggaatcacaaagtctctaaatttccaaagttaactggaaatattacaaactgcagaataattccaggccaaaatatgttaaattcataacatgatgtatatcaaaggaaaaaaggacatgttggaaatgacacattatcttcagtgtataaaatattcatttatgtgaagtttcttggaaaggctacactactattactggtttccgtctgatgtttgagatctgttgattttatgcttttcttacaggcctttcattatgatctttgggaaggaatcaataaaatgatagggcctacttcattaggtgtggttcattcctattcatgctccctggaagaacaagaatgctgaattttgaaatttaatattgtatgaattagcatcagggagaggtggagaaaaatacaaaactaaaagtcatgcttattgtgttcagtgtgcccttctccagagggccactggcttataggaaaggattgctgctctaccagttgaccaggagatggcacgccaggacattaagacactggagttttgtttcgttttttttttttttgatgagttgagactctgcctcaaaaaaaaaccaaaccaaaccaaagaaccagaatagcatgtgcacatatacacagacgtttcacaactggcattatgttttgctactgttttatttacaatgtatcacaagttttatgctttaataaaatttaatcataa

SEQ ID NO: 318725 - DNA, 1013 bp, Homo sapiens
agtggtcaaaactggcacaacacaggatttatactggagagcaacctcacaaatgtaatgaaagtggtaaggctttttatcaaatgtccttgtctttggggtcatgagaaaattcatacagaatctattaaaaatgtactaaacatggaaagacctttaagcaacagtgatgtgatgaaggtggtagttttttaaatgaactcccataagagtctacacaccatagaactcataccaggaatcacaaagtctctaaatttccaaagttaactggaaatattacaaactgcagaataattccaggccaaaatatgttaaattcataacatgatgtatatcaaaggaaaaaaggacatgttggaaatgacacattatcttcagtgtataaaatattcatttatgtgaagtttcttggaaaggctacactactattactggtttccgtctgatgtttgagatctgttgattttatgcttttcttacaggcctttcattatgatctttgggaaggaatcaataaaatgatagggcctacttcattaggtgtggttcattcctattcatgctccctggaagaacaagaatgctgaattttgaaatttaatattgtatgaattagcatcagggagaggtggagaaaaatacaaaactaaaagtcatgcttattgtgttcagtgtgcccttctccagagggccactggcttataggaaaggattgctgctctaccagttgaccaggagatggcacgccaggacattaagacactggagttttgtttcgttttttttttttttgatgagtggagtctcgctctcttgacaggcatcgcaccactgctcgccagcctgggcaacagagtgagactctgcctcaaaaaaaaaccaaaccaaaccaaagaaccagaatagcatgtgcacatatacacagacgtttcacaactggcattatgttttgctactgttttatttacaatgtatcacaagttttatgctttaataaaatttaatcataa

SEQ ID NO: 318726 - DNA, 945 bp, Homo sapiens
tggtagaagtaatgtaggggaaatggcgattatctttttttaaaagcaatagctgttgtatatcaatgataaatgaaaaattagttattcttgtaaattgaagaaagaatggttatcatagagggtagttcaagtgattctcctgcctcagcctcccgagtagctgggactacaggcgtgtgccaccacccccagctaacttttgtatttttagtagagacagggtttcgccatgttggccaggatggtctcgatctcttgacctcatgatccgcccgcctccgccttccaaagtgctgggattacaggcgtgagccagtgtgcccggccgacactgggctttttatgagagtgacagattactaggacctcattatgtggtagaagtaatgtaggggaaatggcgattatctttttttaaaagcaatagctgttgtatatcaatgataaatgaaaaattagttattcttgtaaattgaagaaagaatggttatcatagagggtagttcaagtaaaagaaccagggctgggtgtggtggctcacgttctgtaatccctgtactttgggaggccaaggcagatggatctcttgaggccaggagttcgagaccagcctgaccaacatggcaaaaccgtgtctctacaaaaaatacaaaaattagccggacatcgtggtagatgcctgtaatctcagatattcaggagaccgaggggaaaatcacttgaacccgggagacggaggttgcagtgagctgagatcgcaccactgctcgccagcctgggcaacagagtgagactctgcctcaaaaaaaaaccaaaccaaaccaaagaaccagaatagcatgtgcacatatacacagacgtttcacaactggcattatgttttgctactgttttatttacaatgtatcacaagttttatgctttaataaaatttaatcataa

SEQ ID NO: 318727 - DNA, 1011 bp, Homo sapiens
ttatcagagcttttaacaaatagtgctcccagctgttgctttcagcaaaggagatctccaattaaagagagtaatcatgttctctctactttcgagactatattccttgttaaattgacttctaggtttcatttcccaaggaatctaacaataataacagaagctaaggatgaacttgaattttaagtctatttcaacaaaaggattatattcatttactaatttgtccagtaaacaggaatgcttaagatgtatacttagatttaataatgtgactgaagactgtgtctctgtctctttatttttagcttagctttgtgtgaaaaaataattaatactgatcttctaatttaatactctctttgtgtaacattgtatgtttcttcttgtaatgatcacaagcaaacatctcttatacatagtgttttcaatctatttgttagccaagttataaaactgtagcctagtcaaatctatggcaaagcaatttgatgatattttgtaaaacaatataatttatttcttcctccccctttctcctttcagctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaatacgggggcaacaaaggggggaattgaccaaagacaaaaagttcccagtttccgtgtccaggcctcatcagatctcggagcagatttacgacttgaacttgtcctgagcacggtacaaagtgtactgaagaccgggcgacgggggggacggacccaatgagaccaaaacctgcgcgggaccgcaggagtcaaataggacacagggagtggacctagcacacgaggttcaccggtagtcgagcaacagcgag

SEQ ID NO: 318728 - DNA, 6293 bp, Homo sapiens
  misc_feature (6115)..(6115): n is a, c, g, or t
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318729 - DNA, 6001 bp, Homo sapiens
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 318730 - DNA, 6241 bp, Homo sapiens
  misc_feature (6063)..(6063): n is a, c, g, or t
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatgctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318731 - DNA, 5737 bp, Homo sapiens
  misc_feature (5559)..(5559): n is a, c, g, or t
ccgggctgcaggaattcggcacgagactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318732 - DNA, 6436 bp, Homo sapiens
  misc_feature (6258)..(6258): n is a, c, g, or t
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctaggggacagaaaaagcagagactggagaatatgtggctggaatatatgatggacatctagggaagaattaagaaagaaaagaaaatggctggggagagatggtattgcatcgcttgactcttagagaaggctctggatgattgacagattatcctcatgtctgacggaagtaagacgagcaagttccttcaagaaggaaatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatgctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318733 - DNA, 6239 bp, Homo sapiens
  misc_feature (6061)..(6061): n is a, c, g, or t
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagccccaaactactgtaatccacaaccctgatggaaacaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaactaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318734 - DNA, 4321 bp, Homo sapiens
  misc_feature (4143)..(4143): n is a, c, g, or t
ttatcagagcttttaacaaatagtgctcccagctgttgctttcagcaaaggagatctccaattaaagagagtaatcatgttctctctactttcgagactatattccttgttaaattgacttctaggtttcatttcccaaggaatctaacaataataacagaagctaaggatgaacttgaattttaagtctatttcaacaaaaggattatattcatttactaatttgtccagtaaacaggaatgcttaagatgtatacttagatttaataatgtgactgaagactgtgtctctgtctctttatttttagcttagctttgtgtgaaaaaataattaatactgatcttctaatttaatactctctttgtgtaacattgtatgtttcttcttgtaatgatcacaagcaaacatctcttatacatagtgttttcaatctatttgttagccaagttataaaactgtagcctagtcaaatctatggcaaagcaatttgatgatattttgtaaaacaatataatttatttcttcctccccctttctcctttcagctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318735 - DNA, 3667 bp, Homo sapiens
  misc_feature (4)..(4): n is a, c, g, or t
  misc_feature (3489)..(3489): n is a, c, g, or t
tgtnattcggcacgagctcgtgccgcacatatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318736 - DNA, 2804 bp, Homo sapiens
  misc_feature (2626)..(2626): n is a, c, g, or t
atagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318737 - DNA, 1919 bp, Homo sapiens
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctaggggacagaaaaagcagagactggagaatatgtggctggaatatatgatggacatctagggaagaattaagaaagaaaagaaaatggctggggagaggcaagtatttaaaaaacaaccgcatgtgttagtagagaagaggataagagtctaaattttgacatacgtgtattagtaaacctaagctacttttgactttgcacactgtttatttatgttgtggtcacagagttaattatatctgttagaacaagcctttgaaagtttaatgagctctttagcattaacaacctttcatatttccttatttttttttcacctttccattcatccatcttaaattttgcagctcttaacaatgttattgcactagaaccccagagcagcattaggtgagtggaatgtgttccagggttaaaataaaaacaaggcacagtacatagtgtgttattcctattacataaagtattatataaaaacaagctaaatttctgctattagaaatcagaatagtggttattctggtgtggaggtaggggcagggagtaggagaggcttctgggtgctggttatggcacccagatctgtttcttgatctgtgtgctgatcacatgtgtgttcattttatgaaagatcattgtgcaatatactcatgacatctgcagttttctgtctttgtattttatacttaaatattcaaaaaattgggtgaaggaaatgcctgtgggctggatttactttgcttcacttagacctttaagaatcacagaaccac

SEQ ID NO: 318738 - DNA, 1764 bp, Homo sapiens
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctaggggcagtcaagaaagtactgtaatttctcaacttcatggttacttgtcttgaattggaagtagaactgagactatgtagatggattaagttctgattatacattattgatttggcaaattggaacaatttggacaaattaaaatttgaaggtttcttggcaagaacaacattttaagaaaaaaattagtaaatcatttttatatttgtacatagaatctccacaactcttcagttatggacccagaagtggcatgtgtcatccttattattttgtatcctttacttacgtttagttgtatttacattcttctataggtcttcatattaaacattcattttcttctttcattgaatgaaagcattactgctcttcagaactagttaggagacacaaataataaaaaaaaaaagtatatccacacttccaggaaataatagaattcttttctgtatttcattaaatgaagaaaataaagaaagtggttgtcaggtgccatactgtgatattaataactagtgtaaacctctacctgattgtgtgagaactttgtttagacaattagattaatacttctcatttccattgaaatgttgaataaactgaatataaaaatta

SEQ ID NO: 318739 - DNA, 790 bp, Homo sapiens
ggaggctaagccgggaggattgcttgagtctggaaggttgaggctgcagtgagccatgattgcaccaatacactccagcctgggcaatggagcaagaccctgtctcaaaaataataataattattattattattattgcagaagtatttaatttcagaatcaaagatagttttataggatttggagagtgtcttacacttggacaataggacttggagagcatttttaaaaaatagtaaacctcaatcaagagttagaaaaactggaaaattcaccttaaaaataaaaaagtagaaattataaaaaggggcctcctaaaatattgtgtattatcatctgcttgaactggataaattagtttgttcctatcagagttctctgcaaaatgtctttttaagagtctgctcctcaacccaccttgccaaggtttatgatagaacttttgtatgtaagtgtttttagaggctctttccttcagtgactggtaaatcagaatgtttacacatgaaacaacaaaacacattaaagcacctattaattggttgttttcattatttttcttttacagaaaaatctgtgacccaggccttactgcttttgaacctgaagctttgggtaatttagtggaagggatggattttcaccgattctactttgaaaatggtacatttattcctaatttaataacatgccctttttaaacctctctgaattttcccaaatttgcagattattttgctcttttctacaatgagagtttttaccttcatccagcatttgaaaccataca

SEQ ID NO: 318740 - DNA, 4619 bp, Homo sapiens
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctga

SEQ ID NO: 318741 - DNA, 6197 bp, Homo sapiens
  misc_feature (6019)..(6019): n is a, c, g, or t
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaactaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318742 - DNA, 5070 bp, Homo sapiens
  misc_feature (4892)..(4892): n is a, c, g, or t
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagccaaaccatggtctcttctgggaaaatgttgctgagaaccatatagttaaccactaagactcctaaaagcttctctaaactgtaccctccaatccagccttcacatggctgccctttttttttttttaatacgaacctgtccttgtaacactttgatgttaccatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttactcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaaaaaaaaaaaaaataaaaaaaaaaaaaaaaaaaaaaaaaaggggggggggcgcctaaaaatataaccaccggagggcggacaatactatccacaccccacgtttttgtaaacagnggccccaatgagagggggtatataaagagacggagacagcgcactatcaaaccgcccgcgcggcacaaggcctggactctggcgaacacccccgtgtgcgagactaggcacccactcggatttaccccggacaacactccgtctgagtacccacgcattacgcgacatcgcggcatga

SEQ ID NO: 318743 - DNA, 2570 bp, Homo sapiens
tctctgtgcgggtttaaatgggtaactgtgacttctcgcctcattcacccaaacctccagtcttctcccccgcacatcctcctccacccacctggtttctccctagactggtgtgctcgtgtgtgcaaccaaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtta

SEQ ID NO: 318744 - DNA, 1226 bp, Homo sapiens
  misc_feature (33)..(33): n is a, c, g, or t
  misc_feature (36)..(36): n is a, c, g, or t
atctttgactacggtgaaatccccaactttccncgnaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 318745 - DNA, 1497 bp, Homo sapiens
  misc_feature (33)..(33): n is a, c, g, or t
  misc_feature (36)..(36): n is a, c, g, or t
atctttgactacggtgaaatccccaactttccncgnaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcaaaaaaaaaaaaaaaaaaaaaaaaaaaaaaaaaaaaaaaaaaaaaaaaaaaaaaaaaaaaacaaaaaaaaaacaaaaaaacaacaaaaaaaacacaaaaacaaaacaacacaacaacagagaacagaaacaaaagaaagacaaaataaagaaaggaggaggcgaagagacgcagaaaacaaaatgagaagccgacggcgagcgaacgcacgagacagtggacgggacggcaacacaacaggggagcccaggcgacacacgcaagaccccgca

SEQ ID NO: 318746 - DNA, 1200 bp, Homo sapiens
  misc_feature (33)..(33): n is a, c, g, or t
  misc_feature (36)..(36): n is a, c, g, or t
atctttgactacggtgaaatccccaactttccncgnaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 318747 - DNA, 1031 bp, Homo sapiens
  misc_feature (33)..(33): n is a, c, g, or t
  misc_feature (36)..(36): n is a, c, g, or t
atctttgactacggtgaaatccccaactttccncgnaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcccgctcggtctacccagagcagatcaccgctgtcctctgtagaaggcgccaggt

SEQ ID NO: 318748 - DNA, 1150 bp, Homo sapiens
  misc_feature (33)..(33): n is a, c, g, or t
  misc_feature (36)..(36): n is a, c, g, or t
atctttgactacggtgaaatccccaactttccncgnaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagcgcctgggcgttgttggtcacctggtatttctcccgttccactccggtggccgtgccgccggcgattgcccatggttacgccaaggcgctgaaacaggcacgcaacggcgaaccaggcgccgcccgcgtgctgtatcaacagctgggccgcccggacttgtcgcctgaacgtcgcgccgccttgcacgccgaactgcccaattacccaagccctcaagcgctgaagctggcggataaaggcctggcggatgagtcgccattggttcgcgaggcggcgattcacagcattgtcggcctggtgcccagcggccaacgcaccttgctgcttggcccggcattgggcgacccagagcaagaagtacgcttgccaataagcgcctgg

SEQ ID NO: 318749 - DNA, 1088 bp, Homo sapiens
cagtggcatatgaagtgctatggtgaaaaatacaagagaagacatggccactgttcttgaatggaaaatttaattgggactaaaagacatatatatgcatcaaacagttaagcaagtgatcaatatgcaaatgcatgttaatatgctaaaaactgcattgctatagcacctaaaagtatagaaattataactagggtgcaaaatgtacatgggaaaggtttaagaaaagcacattataagcaggtaagaatcaaaaggaaggaaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 318750 - DNA, 1541 bp, Homo sapiens
tcaccagacttaaactttctgaaagcagagataataatgagtcttttacttaattacaacctaacattttgagcagagcgagtaactcacagtaggtgcttaatggatatgtgttgcatgaaaatataatcccattcatttctctttctgttttgtatacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 318751 - DNA, 1655 bp, Homo sapiens
tcaccagacttaaactttctgaaagcagagataataatgagtcttttacttaattacaacctaacattttgagcagagcgagtaactcacagtaggtgcttaatggatatgtgttgcatgaaaatataatcccattcatttctctttctgttttgtatacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtatgtatgttactccgttttttttaggtgggtaggatttaaagacttctctaggagctgtgggagaatttttaaaattccgtttatgtgagataattcaacctgtgtcctaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 318752 - DNA, 792 bp, Homo sapiens
  misc_feature (33)..(33): n is a, c, g, or t
  misc_feature (36)..(36): n is a, c, g, or t
atctttgactacggtgaaatccccaactttccncgnaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagcgcctgggggatcctctagagtca

SEQ ID NO: 318753 - DNA, 462 bp, Homo sapiens
cattattattccagagtattgtaaagactcataacttggattttttttaactgtagactttttttattgaagtgaaattcataaaacgttaagttaaccatttaaaaataaacaattcaggcccatgcctgtaatcccagcactttgagaggccaaggccagggggctttaggccagcagttcaagaccagcgtgggcaatatagtgagacctcattgctaccaaaataataatttgctgggtttagtggtgtctagttctagctactcaggaggctgaggtgggaggaaagcttgagcctaagtggtcaaggctgcagtgagctgtgatcatgccgctgcactccagcctcagcaacagagcgagactgtctacaaaaaaatgaaaaataaaaataaacaaacaatgcagtggcatttagtacattcacaatgctgtgcaaccatcatctctgtctagttc

SEQ ID NO: 318754 - DNA, 956 bp, Homo sapiens
atgtcatagaattctcaaaacttcctaactgcttctctctctctcttttactcttactctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggtgggtgggggagcagggcgttctgtcgataaacgagctcccttctttgcacacatagccagttaatcgggcattctgagatagtttggatggggagggggagcttctgagaatcgccagtgacagttaagtggcctattgttgacgtcctctgctgaacgacttggttggattcagcttctgccttacccccaccccctgtggattttctgttagattcatcatttgccattcaggcatcatctttcactttctccttccaacatgactgctttgtgtgctggcccctgctttactcctgctattcccaaactataaagggaactgtgtggggcttcagcaggactgagaaattgactctgctgtctgttgagaactctaataatgactgcggtgaccttcatgtctagcagaaaacccactgtctgtgctagcacaatgatgaccacctgaagacagagaaaagggaatcttgattgaattccttctcatacaatatatagttatttcctttgttctcctctccattctcttctcttc

SEQ ID NO: 318755 - DNA, 969 bp, Homo sapiens
atgtcatagaattctcaaaacttcctaactgcttctctctctctcttttactcttactctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgagagatggatgctttgatgctcacaaggggctgccctggcaaacctcctgagagaaaagaaaagctaaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggt

SEQ ID NO: 318756 - DNA, 902 bp, Homo sapiens
atgtcatagaattctcaaaacttcctaactgcttctctctctctcttttactcttactctttctctctcactctctctcttttcccacccttaagccaagtacagggatagttgtctcatcattggtggcttaaaatgatgtttttgaacaagaagacgccccatgggtacttttggtgactagcactatctctgtttttttccttttaaattcctgagctattgtttagcagtacacccttttatctccattgctactgaagctgaatgttacttgggtggaaagcataactgctttcttttctatgtccttaaaccctttgataatgttactgtttgagagtccctgaagccaggatactagaagagtctggcttgtctgaacagctgaactacgaaataatggagtagggcaggctttaccaagccaattcactcaagttgtctcatctataccccttcaaaccctgtgaggctgggctttccagcctctaggtgctgtgctgtcctgaggcctgggccatggtgcccaaggaaagcccctgaagctcaccaggaggaagaagcatgcagggcacccctggaggcgggacgcgccctgggccatcccccgtggacaggcggacactcctggtcttcagctttatcctggcagcagctttgggccaaatgaatttcacaggggaccaggttcttcgagtcctggccaaagatgagaagcagctttcacttctcggggatctggagggcctgaaaccccagaaggtggacttctggcgtggcccagccaggcccagcctccctgtggatatgagagttcctttctctgaactgaaagacatcaaagcttatctggagtctcatggacttgcttacagcatcatgataaaggacatccaggt

SEQ ID NO: 318757 - DNA, 2450 bp, Homo sapiens
aacgccccatatccgggttcccgccgtctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaaaaaaaaaatg

SEQ ID NO: 318758 - DNA, 2302 bp, Homo sapiens
ggacagccggcccagccccgccccgcctcgcctcccgacctgtcgcggatggctgggagagaaggggaacacgagacccttgacccaggacctgcggggacccgccctccctcaggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaaaaaaaaaatg

SEQ ID NO: 318759 - DNA, 1934 bp, Homo sapiens
tataaattcgagtaaattttatctttagattatggcaagaaaagttacctgctgaaatgaagcaatttctaaattgtgtttactttgattttcagtgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaaaaaaaaaatg

SEQ ID NO: 318760 - DNA, 722 bp, Homo sapiens
ctgacttaaccttttagaagaatcactggctcctgggaagaaaatagactgggtatgtgttatacagcaagaatagaagcaggagacttctgcaattccttttcctaattattcagctcatagaagagccattatatttttatttcagagaaacaagggagaagttgcatttcacttaactaggatattactggcccttttaaaacaccctaactgctgtttagcaaattttataagcatgattaatatgcttgtgactctagggttgtgctgttcaatacggtagccacttgcctcatatgccttttaaatgtaaaattagataaaattaaaaatcatttccttagtcacactagccacatttcaagtgctcagtagccactggtggctagtgactgccatattgaacagcacagatatagaatatttccaaaactgtagctagttactggacacctctgctgaaggccttgggtagggcagctcacgcatgtgaatataaatatagtataggtaatgttcaaattcttgaactgttttttaattagtccaatctagagaataaattattaattgtgttagcataatatattaaatttgctcatttgtgcattgctcatttcagtttgtacatgagaaggaaattatggcagaagatgatcaggtgtttcttatgaagctacaggtatgaaattatatcagaagcagacttagtatggtta

SEQ ID NO: 318761 - DNA, 530 bp, Homo sapiens
tgggagggagcacttttcacctgacacacccaacccccctgccgcagcccagggccgcggatgagcggaaggaaagcacttccatactgtcagatcactgggcttcagttgcagcatagcggcccaccccgccgcccgcgtacgctcagcccctcagcgccggccaggcagccacgcacgcgcagtccgttctcgctcgctccatcagtcctggcccggcccggggccccgcccccgcaggccccgccccgctcccgtgcgctgaacgccccatatccgggttcccgccgtctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtaacgactccacctctccctcag

SEQ ID NO: 318762 - DNA, 2503 bp, Homo sapiens
aacgccccatatccgggttcccgccgtctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaaaaaaaaaatg

SEQ ID NO: 318763 - DNA, 1712 bp, Homo sapiens
aacgccccatatccgggttcccgccgtctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgta

SEQ ID NO: 318764 - DNA, 2449 bp, Homo sapiens
aacgccccatatccgggttcccgccgtctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagattaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttcaaaaaaaaaaatg

SEQ ID NO: 318765 - DNA, 1721 bp, Homo sapiens
aacgccccatatccgggttcccgccgtctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtcctgcatcctcagcgaggtctccacccgctcgcgctccaagctccctgcggggaagaacgtgctactgctgggtgaagatggagctggaaaaacaagcttaataagaaaaattcagggaatagaggagtataagaaaggaagaggattggaatatttgtacttaaatgtgcatgatgaagacagggatgatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagttgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaagtgtgatgccattagtgtattggagaaagaacatgactacagagatgaacattttgattttattcagtcacatatccggaagttttgtttacagtatggtgcagcacttatttacacttcagtaaaagaaaacaaaaatatagacttagtatataaatacatcgttcagaaactatatggatttccctataagattcctgctgttgttgtggaaaaggatgcagtatttattccagcagggtgggataatgataagaaaataggaatattacatgaaaattttcaaacattaaaagcagaagataattttgaagacatcataactaaaccacctgttcgaaagtttgtacatgagaaggaaattatggcagaagatgatcaggtgtttcttatgaagctacagtcccttttagcaaagcaaccaccaactgcagctggaaggcctgtggatgcctcaccaagagtcccaggaggctccccacgaacaccaaatagatctgtatcatctaatgttgccagcgtgtcacccattcctgctgggtcaaaaaaaattgatccaaacatgaaagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggccagaagcctgtcttagatgttcatgcagaactagacagaattacacgaaaaccagttacagtttctcccacaacacctacattatcccagaaaacagaataaatggctttatttggtatcttcaagaagcttctccttccgtaggagatgtaggtcgacgc

SEQ ID NO: 318766 - DNA, 1116 bp, Homo sapiens
cgggctaccccggctactcctgctcagcatggctgctttagggactgttctcttcacaggtgtccggaggctgcactgcagcgcagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318767 - DNA, 1225 bp, Homo sapiens
cgggctaccccggctactcctgctcagcatggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgcagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318768 - DNA, 688 bp, Homo sapiens
  misc_feature (474)..(474): n is a, c, g, or t
  misc_feature (484)..(484): n is a, c, g, or t
  misc_feature (486)..(486): n is a, c, g, or t
cgggctaccccggctactcctgctcagcatggctgctttagggactgttctcttcacaggtgtccggaggctgcactgcagcgcagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaaaaaaaaaaaaaaaaaaaaaaacaaaaaaaaacaaaaacaaagaaaangaaaacaaananaaaccagcgagcgggctccctacttctccggggcgggggacaaagcagaagggcgagaagccagccggcggacgggagcagacagcagtgctctcgaaccaccaccgctctttcgggacacagggggggaaaaccggccgggcgcccccatagaacgggggcgaacacacattgagacgacaggggaaccacatatagaggc

SEQ ID NO: 318769 - DNA, 952 bp, Homo sapiens
gtgggaccacaggcacacaccaccattcctggctaatttttttttttaacttttagtagagacaggctcttgctatgttgcccaagctggtcttgtactccttagctcaagtgatccacttcagcctcccaaagtgctgggattacaggcatgagccaccacgcccagcctatggaccttattcttaatccaggcttcccttctcgctaagtttgtggtcttggacaaattacttaattttatcttagtctcagtttccatatctgtaaaagaatacctatctcatgtggttcttttaaggataaaatgaaacaaccaatgtaaagcatgtggcatacacaatattggttccccttcctggtaaataacacctcttctctgtcttgccttcaaacttttgggcagagttttcactctgtttctttctttgcggaaagtaaactacttgggttagatactgcatcttttcagcaagtcagcaggtatttatggatttttattaacatgcttatgtgtctacactatactgtgaatagcaaaagctagcaacacagtccctgacccaaagaacttaaagtctaactgggacaaagcatggactttttaaaaattaagtaatagtattcagggccatgcatctacagttccagatatcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318770 - DNA, 997 bp, Homo sapiens
gtgggaccacaggcacacaccaccattcctggctaatttttttttttaacttttagtagagacaggctcttgctatgttgcccaagctggtcttgtactccttagctcaagtgatccacttcagcctcccaaagtgctgggattacaggcatgagccaccacgcccagcctatggaccttattcttaatccaggcttcccttctcgctaagtttgtggtcttggacaaattacttaattttatcttagtctcagtttccatatctgtaaaagaatacctatctcatgtggttcttttaaggataaaatgaaacaaccaatgtaaagcatgtggcatacacaatattggttccccttcctggtaaataacacctcttctctgtcttgccttcaaacttttgggcagagttttcactctgtttctttctttgcggaaagtaaactacttgggttagatactgcatcttttcagcaagtcagcaggtatttatggatttttattaacatgcttatgtgtctacactatactgtgaatagcaaaagctagcaacacagtccctgacccaaagaacttaaagtctaactgggacaaagcatggactttttaaaaattaagtaatagtattcagggccatgcatctacagttccagatactcgggaggctgaggcaggagaatcgcttaagcccaggaggcagaggttgtaataatctgagatcatgccattgcactccagcctgggcgacggagcgagaccttgtctcaaaaataataataaataatatttcaatactctgcgcctttccaaaaggacctgaggtagctaaataacacttaaaaaaataaaacagaagagtacagtaaatgtcccaaggcaaataggtgaatattaaatattcagtacttctttcagaagagaaggctgatggacttgaagagatgagcgtttctgggaaagttagggtttgagtggacctaaggatgaagatttggctgga

SEQ ID NO: 318771 - DNA, 1146 bp, Homo sapiens
cgggctaccccggctactcctgctcagcatggctgctttagggactgttctcttcagtgagtgggtatagatagggaccgtggactcgggggccctttggggacgggccccttaccgagctcccagactggtcatatgcgggggtatgatcctgcttaattggataattggtgactgaggaagatggtgaagattttttctacttgttatttactatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318772 - DNA, 1190 bp, Homo sapiens
cgggctaccccggctactcctgctcagcatggctgctttagggactgttctcttcacaggtgtccggaggctgcactgcagcgcagccgcttgggcgggcggccagtggcgactacagcagggactggctgccaacccctccggctacgggccccttaccgagctcccagactggtcatatgcgggggtatgatcctgcttaattggataattggtgactgaggaagatggtgaagattttttctacttgttatttactatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318773 - DNA, 1299 bp, Homo sapiens
cgggctaccccggctactcctgctcagcatggctgctttagggactgttctcttcagtgagtgggtatagatagggaccgtggactcgggggccctttggggacgggcacaggacccctgatccggctgcgcggcctctcccccaactctgctctgttctcccagcaggtgtccggaggctgcactgcagcgcagccgcttgggcgggcggccagtggcgactacagcagggactggctgccaacccctccggctacgggccccttaccgagctcccagactggtcatatgcgggggtatgatcctgcttaattggataattggtgactgaggaagatggtgaagattttttctacttgttatttactatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318774 - DNA, 1162 bp, Homo sapiens
  misc_feature (59)..(59): n is a, c, g, or t
ttctcttctagtgatgtggcacggtgtccgtgagcttgtgactgcagcgatacgctgcnttgtggcgtgtcggccaggtggcgactacagcagggactggctgccaacccctccggctacgggccccttaccgagctcccagactggtcatatgcgggggtatgatcctgcttaattggataattggtgactgaggaagatggtgaagattttttctacttgttatttactatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318775 - DNA, 1082 bp, Homo sapiens
tggacatattttaggataattaagctacaatgtatatgaaatggaagagaggagctagagattggttcttcccttattcctatcacagtatttgcacaaggtgatgcagtccatctctaacacttgacttttctctcacttctacttgtagatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318776 - DNA, 905 bp, Homo sapiens
tatacggctgctgaagacgacagaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318777 - DNA, 1051 bp, Homo sapiens
cgggctaccccggctactcctgctcagcatggctgctttagggactgttctcttcacaggtgtccggaggctgcactgcagcgcagccgcttgggcgggcggccagtggcgactacagcagggactggctgccaacccctccggctacgggccccttaccgagctcccagactggtcatatgcggagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318778 - DNA, 1181 bp, Homo sapiens
aagtccagcacctacgtgaagaatggtacctcgtttaacatccactatgtctcgggcagcctctccgggtacctgagccaggacactgtgatggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgttagatcactgcctgggaggcttggcttagtactctcatctctggttccattccagttcagctaagtcttgctttaaaatttttacctcctagctgggtgcggtggctcacgcctgtaatcccagcactttgggaggctgaggcgggcagatcacaagatcaggagttcgagaccagcctggccaacccagcctggtcaacatggtgaaaccctgtccctactaaagatacaaacaattagccgggcgtggtggggtgcgcttgtaatcccagctactcaggaggctgaggcaggagaatcgcttaaactcgggaggtagaggttgcagtgagccaaggtcacaccattgcactccaacctgggcgacagggcgagactctgtctcaaaaaaaaaaaaaaatttacctcctttgcaggccataggactagcccaactatgagaaatagctgttctgtgaacgtgaaaaggggacagcagttttcccagttttggccaggcagtcaagcctttaacagctcatgcacagtttaggccatgtacagctggcatctaataaatgttttcatgaaaaaga

SEQ ID NO: 318779 - DNA, 349 bp, Homo sapiens
gcggccgcctactactactaaattcgcggccgcgtcgacaaagaccaagcagaagtaatgtggtccacagccatgcccttgaggagccggccaccagatgctgaatcccctatcccattctgtgtatgagtcccatttgccttgcaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacccccattaaattcactttcaattccaaacatg

SEQ ID NO: 318780 - DNA, 837 bp, Homo sapiens
ttatgagtctcatattcctgctagaagcctgttattgtgctgtgtaggaagaaagagagcaccaggagaggccctgctccagtggagcaagagcaaatcatctttaagttcctcttcttcaaaggctcagaaattaaattaagtattctttgtggtcaagaaggggaaagaacattgctttttaagagaccagaagtggtattcaccatggcttcttccctattattctctgtttaaatcatctgttctgtgtccaggaccagccactgttgcagcatgagttcccagcagcagaagcagccctgcatcccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgccagcccaaggttccagagccatgccaccccaaggtgcctgagccctgcccttcaatagtcactccagcaccagcccagcagaagaccaagcagaagtaatgtggtccacagccatgcccttgaggagccggccaccagatgctgaatcccctatcccattctgtgtatgagtcccatttgccttgcaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacccccattaaattcactttcaattccaaacatg

SEQ ID NO: 318781 - DNA, 645 bp, Homo sapiens
gcggccgcctactactactaaattcgcggccgcgtcgacacagagtattcctctcttcacaccaggaccagccactgttgcagcatgagttcccagcagcagaagcagccctgcatcccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgccagcccaaggttccagagccatgccaccccaaggtgcctgagccctgcccttcaatagtcactccagcaccagcccagcagaagaccaagcagaagtaatgtggtccacagccatgcccttgaggagccggccaccagatgctgaatcccctatcccattctgtgtatgagtcccatttgccttgcaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacccccattaaattcactttcaattccaaacatg

SEQ ID NO: 318782 - DNA, 382 bp, Homo sapiens
tcttagggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgtaagtaatgttagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacccccattaaattcactttcaattccaaacatg

SEQ ID NO: 318783 - DNA, 655 bp, Homo sapiens
ctctcgaggatccccgactacatacttccgaccagttctaagggaccatacagagtattcctctcttcacaccaggaccagccactgttgcagcatgagttcccagcagcagaagcagccctgcatcccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgccagcccaaggttccagagccatgccaccccaaggtgcctgagccctgcccttcaatagtcactccagcaccagcccagcagaagaccaagcagaagtaatgtggtccacagccatgcccttgaggagccggccaccagatgctgaatcccctatcccattctgtgtatgagtcccatttgccttgcaattagcattctgtctcccccaaaaaagaatgtgctatgaagctttctttcctacacactctgagtctctgaatgaagctgaaggtcttagtaccagagctagttttcagctgctcagaattcatctgaagagagacttaagatgaaagcaaatgattcagctcccttatacccccattaaattcactttcaattccaaacatg

SEQ ID NO: 318784 - DNA, 608 bp, Homo sapiens
ctctcgaggatccccgactacatacttccgaccagttctaagggaccatacagagtattcctctcttcacaccaggaccagccactgttgcagcatgagttcccagcagcagaagcagccctgcatcccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgccagcccaaggttccagagccatgccaccccaaggtgcctgagccctgcccttcaatagtcactccagcaccagcccagcagaagaccaagcagaagtaatgtggtccacagccatgcccttgaggagccggccaccagatgctgaatcccctatcccggtgggaagtcgacttcccacgggacatgcagacagatggattatcgggaacactgatggattaacaggaacaccaactggggaaggattcttgacattatttattaagagctaggatgtgattgaggtacgtgggggccactcaatattcaatcatcatttattgaatacttaccactacttacc

SEQ ID NO: 318785 - DNA, 441 bp, Homo sapiens
ctctcgaggatccccgactacatacttccgaccagttctaagggaccatacagagtattcctctcttcacaccaggaccagccactgttgcagcatgagttcccagcagcagaagcagccctgcatcccaccccctcagcttcagcagcagcaggtgaaacagccttgccagcctccacctcaggaaccatgcatccccaaaaccaaggagccctgccaccccaaggtgcctgagccctgccaccccaaagtgcctgagccctgccagcccaaggttccagagccatgccaccccaaggtgcctgagccctgcccttcaatagtcactccagcaccagcccagcagactgttgcagcatgagttcccagcagcagaagcagccctgcatcccaccccctcagcttcagcagcagcaggtgaaacagccttgccagcctcca

SEQ ID NO: 318786 - DNA, 3748 bp, Homo sapiens
  misc_feature (165)..(165): n is a, c, g, or t
  misc_feature (175)..(175): n is a, c, g, or t
  misc_feature (177)..(177): n is a, c, g, or t
  misc_feature (180)..(180): n is a, c, g, or t
aagaacatatactataaggaatgagcatgttgattacgtagatgttggtggagcttatgtgggaccaacccaaaacagaatcttacgcttgtctaaggagctgggcatagagacttacaaagtggatgtcagtgagcgtctcgttcaatatgtcaaggggaaaanatatcctttngnggngctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaaggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcgtcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcagacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaaaaaaaaaaaa

SEQ ID NO: 318787 - DNA, 3510 bp, Homo sapiens
tttagagagatggtgtcttccagcaatctgccacaagggtggttagaggtccaggggataccggaagggtgggatggtgtagcaggatggtatcttccaggaataaaccctggcggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcgtcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcagacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaaaaaaaaaaaa

SEQ ID NO: 318788 - DNA, 2146 bp, Homo sapiens
  misc_feature (165)..(165): n is a, c, g, or t
  misc_feature (175)..(175): n is a, c, g, or t
  misc_feature (177)..(177): n is a, c, g, or t
  misc_feature (180)..(180): n is a, c, g, or t
aagaacatatactataaggaatgagcatgttgattacgtagatgttggtggagcttatgtgggaccaacccaaaacagaatcttacgcttgtctaaggagctgggcatagagacttacaaagtggatgtcagtgagcgtctcgttcaatatgtcaaggggaaaanatatcctttngnggngctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaaggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcgtcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaaaaaaaaaaaa

SEQ ID NO: 318789 - DNA, 2687 bp, Homo sapiens
tctgaatttctgtgccttctgcagactaaatgagggcagtgattggctcatttaccctgcccaccttcccaagtaactctgtgtaacctcttggttcccttgaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaattatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcagacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaaaaaaaaaaaa

SEQ ID NO: 318790 - DNA, 2164 bp, Homo sapiens
  misc_feature (165)..(165): n is a, c, g, or t
  misc_feature (175)..(175): n is a, c, g, or t
  misc_feature (177)..(177): n is a, c, g, or t
  misc_feature (180)..(180): n is a, c, g, or t
  misc_feature (1999)..(2000): n is a, c, g, or t
aagaacatatactataaggaatgagcatgttgattacgtagatgttggtggagcttatgtgggaccaacccaaaacagaatcttacgcttgtctaaggagctgggcatagagacttacaaagtggatgtcagtgagcgtctcgttcaatatgtcaaggggaaaanatatcctttngnggngctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaaggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcgtcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaaaaaaaaaaaaaaaaaaaaaaaaaaaattttggggggggtggggcaggaaaaagttttaagacccatttgttgggggggggggcccctgggtttgggggaagggggcaaggggggccaagaagaaaccacgggcacgaactgtgtgcgggtttcccccccaaaaaaaacgggcggggggaccggggcgttggaacacacccagggggctggggggccatgggttcaaacacgggcccaggggcgcgtataatcgccggcgcggaggnnaagagcaaacaaccgacacaaacagaacacagcacaagaaacccaaactagcacacacacaaagtaagtactaaacaacagcacagtgcaccaagaacacgaccacacaactagcagagcatgaccacctgatctaatcgagacaacacaatacacagaacaga

SEQ ID NO: 318791 - DNA, 3694 bp, Homo sapiens
  misc_feature (165)..(165): n is a, c, g, or t
  misc_feature (175)..(175): n is a, c, g, or t
  misc_feature (177)..(177): n is a, c, g, or t
  misc_feature (180)..(180): n is a, c, g, or t
aagaacatatactataaggaatgagcatgttgattacgtagatgttggtggagcttatgtgggaccaacccaaaacagaatcttacgcttgtctaaggagctgggcatagagacttacaaagtggatgtcagtgagcgtctcgttcaatatgtcaaggggaaaanatatcctttngnggngctttccaccagtatggaatcccattgcatatttggattacaataatctgtggaggacaatagataacatggggaaggagattccaactgatgcaccctgggaggctcaacatgctgacaaatgggacaaaatgaccatgaaagagctcattgacaaaatctgctggacaaaggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgagtgcaaatacgtaattaatgcgatccctccgaccttgactgccaagattcacttcagaccagagcttccagcagagagaaaccagttaattcagcgtcttccaatgggagctgtcattaagtgcatgatgtattacaaggaggccttctggaagaagaaggattactgtggctgcatgatcattgaagatgaagatgctccaatttcaataaccttggatgacaccaagccagatgggtcactgcctgccatcatgggcttcattcttgcccggaaagctgatcgacttgctaagctacataaggaaataaggaagaagaaaatctgtgagctctatgccaaagtgctgggatcccaagaagctttacatccagtgcattatgaagagaagaactggtgtgaggagcagtactctgggggctgctacacggcctacttccctcctgggatcatgactcaatatggaagggtgattcgtcaacccgtgggcaggattttctttgcgggcacagagactgccacaaagtggagcggctacatggaaggggcagttgaggctggagaacgagcagctagggaggtcttaaatggtctcgggaaggtgaccgagaaagacatctgggtacaagaacctgaatcaaaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaattatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcagacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaaaaaaaaaaaa

SEQ ID NO: 318792 - DNA, 2043 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318793 - DNA, 388 bp, Homo sapiens
ttgctctcatgccttccaggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaaggtaggtggaaatgtggtcaagatccctcccatgaaacgtgttctaaaaagagtttcctggtttgcaaaagtacattttgatgaattttagacttgattttgccttgactttctccgttttattgtctcccacacaggggctactcg

SEQ ID NO: 318794 - DNA, 2117 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttacttttttgatgtaggaatttaatgctgtcaactttcctctcagccccacttttgctgtgcctcagaggtttggaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318795 - DNA, 1993 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318796 - DNA, 1964 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcagaactctctgaagaaagtaccggtattgtccccattttccagaggaggaaactgaggctgagaggtcgtagatgacttgctcaaggtcacactgtcagtgcatggtggagctgggattcaacacacatctgtgctgtctgagtgtgtgattttcaaagccaagtcaaaatattctccagaattactcaaataccgggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318797 - DNA, 1482 bp, Homo sapiens
ctgttaaaggcatctccaaaccaagtcccagggtccatatgaagacacttgaaattgtaggaagaaggagtgtgaaaaggactctgatggaagacccaacaagatcacagtgctctgagatcccaaagggctttaccagactgatagcaggtgggggctggggaaggggctggtgtcttggacctggagtgtcccataccttctgctccctcttttccagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318798 - DNA, 2394 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcacaaaaaaaaaaaaaaaaaaaaaaaaaaaaaaaaaaaaaaaaaaaaaaaaaaaaaaaaaaaaaaaaaaaaaaaaaaaagaaaaataaaaaaaaaaaaaaaggaggggcggcggccgcaacaaaaataacctcgcgcggcgaggaggacaacataatgacgcccgcaccctgttgtttggtaaaaagagggggcgccacaagagaggggggtaattaaaaaataaaaggcaagggcaggggggtgaacacacagcacgtgggggaggagaaaaacaacgggaggggggagtgtgtgtgagagagacacaacatattcgggggggggaggagaaaagagggggggacaaagccaga

SEQ ID NO: 318799 - DNA, 1506 bp, Homo sapiens
gcatctcctattagttgctttcccctttaaacccatattctgctagagctgtcccaccctctcacctgccagaaatgacttagagctgagggagtcctcactaccgatatggtgaagacaagaccccctttctactacatagaggaacataattataatgaaaacgacttacgtgtattgagaattaactatatattagacactgttctaagcactttacagatgttaactcagtccccacaataggcccacgacgtagttactaatattactcccattctaagatgaggaaattgaggcatagaagttacttgtccaaagacaccaccacaggttgtgagctgtactccatgttaggattcagatgcagtttgttgctgaaaacatttcctatgcatagtgactggctgggttctctagtcatgctgtatactctgtgctctaaagagttcagtagagttgtcggtgggcatttcagccctgtgtgtagcatggttttgtgggaaaatggactttaagagccatttaaaagaactttagagttatctatagtttacataaaaatctcagctctgtctacctaaactagactatgtcatacatactatataatgtttcaagtcactgaaatatttttttctttttaagttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318800 - DNA, 1690 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagtt

SEQ ID NO: 318801 - DNA, 818 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggtcagtgggggcgctgaggaggtgtcacctgaccagggactcttggtatcctcgaggcattggttccaggaccccagaaaataccaaaatctggatgctcaagtccctgatataaaatggtgtagtatctgcatataacctacacgcatccttctgtata

SEQ ID NO: 318802 - DNA, 2187 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcagaactctctgaagaaagtaccggtattgtccccattttccagaggaggaaactgaggctgagaggtcgtagatgacttgctcaaggtcacactgtcagtgcatggtggagctgggattcaacacacatctgtgctgtctgagtgtgtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318803 - DNA, 1747 bp, Homo sapiens
aagtctcaggagatctgatgggtttatcaggggtttccgcttttgcttcttcctcatttttttctcttgctgctgccatgtaagaagtgcctttcgccacccactgtgattctgaggcttccccagccatgtggaactgtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttacttttttgatgtaggaatttaatgctgtcaactttcctctcagccccacttttgctgtgcctcagaggtttggaccaaccctggaatggtccccagccatggattcagtcccagatcttatttctttgacaaccctcgaagatatgacagtgatgatgaccttgcctggaacattgcccctcagggacttcagggaggttttgctccagattactatgattggggacaacaaactaacagcttcctggcacaagcaggaactttgcaagactcaactttggatcctgacaaaccaagccttgggtagcatcagttaacagttttatggacgattcctcagatgaaaagcttcagaaaagcatagtgacagctgaatttttagggcacttttccttaagaaatagaacttgatttttatttgttacaggtttccaatggccccataggaataagcaataatgtagactgataaacccttattttagtactaaagagggagccttgctatttcagtgggtataatttaaactttttaaagaaaatctgtacttttataaagatgtattttgtataacttaaataataatgctaaagtatactagggtttttttttcttgagaatgttactgcaatcatgttgtagtttgcacagacttttatgcataattcactttaaaaatatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtaggttcctcaaggaatctcttaagttttgcccaaagactggtacttcctttcagtagggcgctaatgtatacacattaatgataagttgataacattaaaaatgtagctgacttatcctattaaacctcctctgctatgttcaca

SEQ ID NO: 318804 - DNA, 1260 bp, Homo sapiens
agtgcggcttgttttctttcctccagtctcggggctgcaggctgagcgcgatgcgcggagacccccgcgggggcggcggcggccgtgagccccgatgaggcccgagcgtccccggccgcgcggcagcgcccccggcccgatggagaccccgccgtgggacccagcccgcaacgactcgctgccgcccacgctgaccccggccgtgcccccctacgtgaagcttggcctcaccgtcgtctacaccgtgttctacgcgctgctcttcgtgttcatctacgtgcagctctggctggtgctgcgttaccgccacaagcggctcagctaccagagcgtcttcctctttctctgcctcttctgggcctccctgcggaccgtcctcttctccttctacttcaaagacttcgtggcggccaattcgctcagccccttcgtcttctggctgctctactgcttccctgtgtgcctgcagtttttcaccctcacgctgatgaacttgtacttcacgcaggtgattttcaaagccaagtcaaaatattctccagaattactcaaataccggttgcccctctacctggcctccctcttcatcagccttgttttcctgttggtgaatttaacctgtgctgtgctggtaaagacgggaaattgggagaggaaggttatcgtctctgtgcgagtggccattaatgacacgctcttcgtgctgtgtgccgtctctctctccatctgtctctacaaaatctctaagatgtccttagccaacatttacttggagtccaagggctcctccgtgtgtcaagtgactgccatcggtgtcaccgtgatactgctttacacctctcgggcctgctacaacctgttcatcctgtcattttctcagaacaagagcgtccattcctttgattatgactggtacaatgtatcagaccaggcagatttgaagaatcagctgggagatgctggatacgtattatttggagtggtgttatttgtttgggaactcttacctaccaccttagtcgtttatttcttccgagttagaaatcctacaaaggaccttaccaaccctggaatggtccccagccatggattcagtcccagatcttatttctttgacaaccctcgaagatatgacagtgatgatgaccttgcctggaacattgcccctcagggacttcagggaggaaaaaacaccttggatctgcctattcctaaattctaattcaatgaacaatgaggacattttaataaaaagcttgg

SEQ ID NO: 318805 - DNA, 1618 bp, Homo sapiens
  misc_feature (31)..(31): n is a, c, g, or t
acgctgcccagactcactacccgccctctcngtcccgcagccacgaggaggacgctgcccagactcactacccgccggctccctcccccgcgtccctgtggtggtgggcgaagatgacctgttgtgcatcagatgcctttgagacatacaactggagatgtgagataggaaattgaatgtaaagactggaagctcggcagagcagaactctgaacaacgtgcctcaggagtgcaagttgctgatgaagtgtgtcgcattttttatgacatgagagttcgtaaatgctccacaccagaagaaatcaagaaaagaacaaaggctgtcatttttttgtctcagtgcagacaaaaagtgcatcatgtagaaggcaaagagatcttggttggagatgttggtgtaactataagtgagcctttcaagcattttgtgggaatgcttcctgaaaaagattgttgctatgctttgtatgatgcaagctttgaaacaaaagaatccagaagaattgatgttttcttgtgggcatcagaactagcacctttgaaaagtaaaatgatctatacaagctccaaggatgcaatcaaaaagaaatttcaaggcataaaacatgaatggcaaacaaacggaccagaagatctcaatcgggcttgtactgctgaaaagttaggtggatcctttttttttttttttgagatggagtcttgatctgtcgcccaggctggagtgcagtgacaggatctcggctcactgcaacctctgcctcccgggttcaagtgattttcctgcccagcctcctgagtagctgggattataggcgtgcgccaccacacctggctaatttttgtattcttagtagagtcagggtttcaccatattggtcaggctggtctcgaactcctgacctcgtgatttgccctccttggcctcccaaagtgctgggattacaggcgtgagccagcatgcctggccagtggatccttaattgtagcctttgaaggatgccctgtgtagatcatcattcagtgccacaaattgaaagcttccacgtttaatgttatcctcttgctatataaataaagcaaatatatttaggccagggtctcactgaggggagctgtcttgtcatcttttagagtaaactaaatactctataaacatatgcaaacagccctaaatatatctgtaggggtgggttgcccctccacacctgtgggtgtttctcgtaaggtgggacgagagacttgggaaagaaaaagacacaaagtatagagaaagaaataaggggacccggggaagcagcgttcagcatatggaggatcctgccagcctctgagttcccttagtatttattaatcatttgtgggtgttctcgaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccaagaca

SEQ ID NO: 318806 - DNA, 579 bp, Homo sapiens
  misc_feature (546)..(547): n is a, c, g, or t
  misc_feature (550)..(550): n is a, c, g, or t
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatccctccacagtcgaaggggatcnntcnagagtcagactcgcacgcatcaactgcaa

SEQ ID NO: 318807 - DNA, 692 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccccaagctttggtcagggctattggttgaatgagtaggctgatggtttcgataataactagtatggggataaggggtgtaggtgtgccttgtggtaagaagtgggctaggcattttaatcttagagcgaaagcctatctgaccaaagcttgggatcctctgaacagc

SEQ ID NO: 318808 - DNA, 874 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaaaaaaaaaaaaaaaaaaaaaaaaaaaaaaaaaatctgctgggcgccggcacccggccccatcaaagaaaggttctttcaaaaccatcgcgtgtggggcgcgcggggcccactcatcggaacatcggagccatcggcgccacaagtggggccccaaggaaatcctggcgcaagagcaatgcggtgggcgtctcccccacataaaaaaacccccggcgggaccccggaggtgtccgaaacaatcccaaaagggggttccgggagccaaaccgggtca

SEQ ID NO: 318809 - DNA, 1120 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaaaaaaaaaaaaaaaaaaaaaaaaaaaaaaaaaagggggggcctctggtgggggggggggaaaaagggggaaggaagggggcgggggcacaaggggttccgcggcccccaagttattgtgtgggcacgaacggggggacaccactgcggagggcctcccgataaaggagacgcgggaataaatttgcgaagaagccccggggtctaccgcgcggtttacagaacccggggaagaaactgccgcaggagcatataagaccccgcactggaaggacgcggcaggattgtaagggtgcgacaggaagaagataggccatggcggcagacgccttcttgtcgcgggacagtgaaacaccggggcgcctatgagagacaaaaagaaccaccggaacgcaccacgcggaggtgaggacacgggggcagcaggagggcacccacttcctggccgcagaggcaacgggccggcacagcagcccacaacccctgtgagggccgcacaagggagaccgaagaaggcggccac

SEQ ID NO: 318810 - DNA, 793 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaacaaaaaaacaacatacagcacaacaaaaaaaccgtgtggcgcgagcgagactatgaggcaccctaggaaacagcgtagaatacaacaaatcggatgggggagcaggaggcccacagagggagaaggtgaaacctgtgggccatacgcgggtcccctaaggaagaacccgggggcatagaacaaaaggggctgg

SEQ ID NO: 318811 - DNA, 498 bp, Homo sapiens
  misc_feature (27)..(29): n is a, c, g, or t
ttcgagttcggtaccctcatagggcannntggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318812 - DNA, 543 bp, Homo sapiens
tgatgacttcatcattcactgtaactccagaagccatagtgccctcggctgtggctgcgtcggcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318813 - DNA, 760 bp, Homo sapiens
tatttctgaaaacaagttttatttaaataagggtttaaatacattacacataacattaaaactgaaggggaaaaaaaaaccaaaaaccagtttgttacttcacatggcattgggcagctgctgctattaagttgcaagctctacagctagctacatgactgatggatcagtttgagatttgttcccttgtcaaaagtttaactctgatagaaggttggcctcacattctgatgtttggacatcccttagctaggatatgtctggtcgaacagacctttgtggcaagccagatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318814 - DNA, 506 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaggacccgggcgctcggtgtctcttactaatcacctcttttcccagccagctcttgtc

SEQ ID NO: 318815 - DNA, 1423 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaaggtactggtccctgtctcccccacttccccaaactacccacaacatgaaacaagaccctggcagaatggccaggaatgaaggagcagcaactgacaccccacactcttgcttcattttaactcactctaagccagggagtttttccatttaggaagagagatatatgaaatggtatatgacgtaatggaattattttcaaatttcattattctaccccagaggttctatggcagccctgtccagtagaactttctgcagtggtggaaatacattctatatctgctctatccaacatggtagccaccagccacatgtgtctgctgagtgcttgaaatgtggctagtgtgactaacagactgactttctaaattagttaatgtaaatgtaaatgtaaatagccatttgtaaccagtggctctaagtctgtatctgtgttggcagcttgggcaagtggaggatgagactgattaggcagggcctgtggcctttttccacctgaacccgctgtacttttatatagtttatctatgggagttgcatgcaacacttgaaagaagtgttccactggctttacaaaactgaatagcccctaatatcatagaaagagccctggactaggagtgggaaaacctttggttcaaggcccaggtctgccccttaggcaggtcacttcacctcttttagtctgtttctgcatctggcaaatgggaatattaataatccctatcctgtaccttatactcctgtgagaataaaatgtggcagcatatttgaaagcacattagaagatgcgatataaaggtgtaattattattttctctgcagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318816 - DNA, 1699 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaaggtactggtccctgtctcccccacttccccaaactacccacaacatgaaacaagaccctggcagaatggccaggaatgaaggagcagcaactgacaccccacactcttgcttcattttaactcactctaagccagggagtttttccatttaggaagagagatatatgaaatggtatatgacgtaatggaattattttcaaatttcattattctaccccagaggttctatggcagccctgtccagtagaactttctgcagtggtggaaatacattctatatctgctctatccaacatggtagccaccagccacatgtgtctgctgagtgcttgaaatgtggctagtgtgactaacagactgactttctaaattagttaatgtaaatgtaaatgtaaatagccatttgtaaccagtggctctaagtctgtatctgtgttggcagcttgggcaagtggaggatgagactgattaggcagggcctgtggcctttttccacctgaacccgctgtacttttatatagtttatctatgggagttgcatgcaacacttgaaagaagtgttccactggctttacaaaactgaatagcccctaatatcatagaaagagccctggactaggagtgggaaaacctttggttcaaggcccaggtctgccccttaggcaggtcacttcacctcttttagtctgtttctgcatctggcaaatgggaatattaataatccctatcctgtaccttatactcctgtgagaataaaatgtggcagcatatttgaaagcacattagaagatgcgatataaaggtgtaattattattttctctgcagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaaaaaaaaaaaaaaaaaaaaaaaaaaaaaaaaaatctgctgggcgccggcacccggccccatcaaagaaaggttctttcaaaaccatcgcgtgtggggcgcgcggggcccactcatcggaacatcggagccatcggcgccacaagtggggccccaaggaaatcctggcgcaagagcaatgcggtgggcgtctcccccacataaaaaaacccccggcgggaccccggaggtgtccgaaacaatcccaaaagggggttccgggagccaaaccgggtca

SEQ ID NO: 318817 - DNA, 598 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318818 - DNA, 619 bp, Homo sapiens
  misc_feature (14)..(14): n is a, c, g, or t
cggatccccggctncagaattccggcgcgtcgacacggctcgagagacgacagaagggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318819 - DNA, 526 bp, Homo sapiens
  misc_feature (54)..(54): n is a, c, g, or t
aaattaggctagtggaggccgggggtgaatcggccgaggcctcgctcagctccnacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318820 - DNA, 553 bp, Homo sapiens
cacacccaccaaaacacaaggagaggccctgaaaagtaactggaaagtcacagaccgttctggcaagtggagttgatgagaaacaggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318821 - DNA, 658 bp, Homo sapiens
  misc_feature (374)..(374): n is a, c, g, or t
cggcctgggctgcttttattcatggtggaaaggttattaattattattctggaaaatacgcaagattattgttttctgtttccaggggttatgtactgtgttccagatgattaaagcagaaaaagaggggattgagtagcatttccagatttcttaagtactttgctattcgatttgcctttcagtgtagtgtacattgtaaaactcagatattgtcatgatgtttcacttggacataagacttattaatgtggtcacttaaggggtaaggaatttaagaactggatgaggttatttcttcctttactcttcaaaatgtattttgatacatcagtatgagaggacgtcccatcaacaaagcatcgatgatgganagtctcacactatttttatcatatgtttctttgtcagccttctgcttctaatcccagtaagcaacttggacaggcattttaaaagctgaagaaaagtgacacaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318822 - DNA, 319 bp, Homo sapiens
  misc_feature (290)..(290): n is a, c, g, or t
gcggccgactactactactactgctcgaattcaagcttctaacgatgtacggggacatggcaaaaatctccagccctacagagactgagcggtgcatcgagtccctgattgctgtcttccagaagtatgctggaaaggatggttataactacactctctccaagacagagttcctaagcttcatgtgcctgtaatcccagctactcaggaggctgaggcaggagaatcacttgaacccaggaggcagaggttgcagtgagcccagatcgtgccaccgcactctagcctgngcaacagagcaagactctgtcttaaaaaa

SEQ ID NO: 318823 - DNA, 1071 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaaaaaaaaaaaaaaaaaaaaaaaaaaaaaaaaccccggggccctcttatggcgggggggggcaaaaaggggtccggaccgggccctgggtcaaacggggttctcctgaccccctttttttgcaccaggggtaaatcaggggcgccccaaaagggaggcgacaaaatcgcaaaagccggtactgtaatttcctcaccacacaacaccacacacaccaaagagggacagaggggggaccccctgtagaaacaaaaaaaggcacacaaaaaacatccccaccctacacacatatgtccatgatagacgataaaataacaccgagtatatatctattaatagatacacagacacatacaaacagtgacccaaagaagtgcgcgccccctgaaatagcaacaagatcacatgaaaaatgaacagcaacaaaggggctcaatacgctacaccacgatataagcagcataatacacaaga

SEQ ID NO: 318824 - DNA, 557 bp, Homo sapiens
ctaggtcacatcgagccgatatgaggaatccgctcgaatacaatcggggaggattccagcatgtacagtgagcctgatattacaaaagaggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318825 - DNA, 748 bp, Homo sapiens
  misc_feature (14)..(14): n is a, c, g, or t
cggatccccggctncagaattccggcgcgtcgacacggctcgagagacgacagaagggttgaggagaggctccagacccgcacgccgcgcgcacagagctctcagcgccgctcccagccacagcccagttggcccacgccgtcctggccaagctgaacgccttcaaggcagacactcccagtctgggcgagggcccagagaaaacccgctcccagctgctgataatggaccgggcagctgaccccgtgtccccactactgcatgagctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318826 - DNA, 927 bp, Homo sapiens
gatgcccgacgggcgcgaatctgctccacgacacgtgcgacacaggtcacggaaaatcgtgagcgcataaagtgaagaccacgccacatcttgcggccctaaaacagctgcctcagaaagagaacggctccataaattcaaagccgccgagctccacaaactggcgccaggaaccctcctgaatgcggggccccaggaatcctgcaacactggtgaagaaaccctcttggacccacactggggcctaaggggggcccgggcaaggccagcactgcccggcacgatcgctcggatcacaccccgacctcgggcttcctgaggccccgggcgcccggccgagctttgacatagagcggggctgctggcttcagttcacctcaggggagcagcaagagcgaagactctgggcgccacaatacttgggccaacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318827 - DNA, 596 bp, Homo sapiens
  misc_feature (18)..(18): n is a, c, g, or t
ttaagtcccggcacagcnacgagaatccgagcacctctccgagcccctcgctgccgctatcacaccaccctgctacccagagagccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaaca

SEQ ID NO: 318828 - DNA, 646 bp, Homo sapiens
  misc_feature (646)..(646): n is a, c, g, or t
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaacatgaaaaaaaacaaacgaagcgcttatgcatgcggccggatttcn

SEQ ID NO: 318829 - DNA, 1006 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaaaaaaaaaaaaaaaaaaaaaaaaaaaaaaaaaaaaaaaaaaaaaaaaaaaaaaaggggggggggggcaaaaaatttccccggggggggccctgggcccctttttggggaacggggggcgccccaaaggcgggcctcgtattaaatccctgaggcagacgggcgcggccgtaccaaaacacgccgcagtcgcaggggggacaaatggtctcatcgggggacatcttggtgggaggggccccaactcgtggggggggggggaaactatgggggaaacacacacaagaaatattaagaccctcgggagaattaacaaccttttgccgtcttatgggtggtcaccaggcgattttctgggcgcgtaaaattggacgagggtttcgtgacacatttccggggcttttaaatg

SEQ ID NO: 318830 - DNA, 646 bp, Homo sapiens
ttgggcaaggctgggccgggacagggcgtgggttgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacaaaaaaaaaaaaaaaaaaaaaaaaaaaaaaaaaaaaaaaaaaaaaaaac

SEQ ID NO: 318831 - DNA, 449 bp, Homo sapiens
aggggcggggcgtcccgccgagagtctgggtgcggtgcggttttcttttttcttgtgtcccactttattccctgagccacagggaatccgttttctagtacttctctgttataaagtctgcctgccttagacaaacacatttggaaaatagaagtgcaaccacaaggatgtgcagaccctatcagaataaaatcgtagaaccttaccagtcatccggtataatttccacattttccagatgaggtccggggaatgaggtgattcgcccaaaagcacactacaaattggagtcaccagcaggtctgctattttgccactaaaccaatctgccggtcacaccttggctgtaaagtgtcctaacagccacctacttatgattactgctttcttaccaataacctccccagcctgttgtgtggctcctacatcttgaacaaaagcgaccaagg

SEQ ID NO: 318832 - DNA, 409 bp, Homo sapiens
tactgtttagaaagtcatcatggtgtggtagaattacacagcttgtgttctccatctaggtaattttaaataaatcatttaactttttcatattaggtattcttacctattgaaagcgaagaactaataccttgttttcttactagagtggccatctgctggatttgccagcttgacagtcatttctccttcttcctaattttcctttgcacaaacatcccccacaacatgcagtccaggtattatgcttggtggtaactggaacctcactcaatctagaaaagtaagggttagccttgagacatttaatgcaacaacttgaaaagaggtgggctctttccactggtaacttaaagtggccagaggccatctttgccaccacttggggtaactccaggactgagacatg

SEQ ID NO: 318833 - DNA, 3943 bp, Homo sapiens
cgaggccccgaaagccatggcagcagaccttctcagaagtttttggcactcgttggaagatcctgtggttcattcctttcaggcagaggcaaccactgcgagttccctaccactttgccaatcatgtctaaacagatggatggtgggcacagatgggtcctccatgctggcaatgcgttacaggttttatgataatagaactatgacagtcttcaagtcaattaaaatccacccaccagtcttaggcatcataatgtgccccaggctttattttaatagtgatcttgatcctgttgtgggactaatacaagatctatatttaagttttaaagcatgtttactttcaaattagctttccacagggatttcttgaaatgcttttgttattaaactcaaaaggcagtgattaggatgaaataattgtacataatttattttagtactgacagtgttacagattctaatttatggtaaatttcagatgtttatttaaaattttcacttttaaacagtaaccaaatctaaatttaattattcaggttttacaaaagttgatacaccttcttatagtataggtaaattttctttttcaaatccaatttaaaataacctttccttttaaatgtgctgcaacgtttttaaaaatgcagcagcataggagtgaacaacagcaacacaaaacgggcattggtttcttaggagtggcttgcttacgttttcttcttttttcttcaccaaaaccaacatgaaagtaccactgaagtaaaacaccaactacctaccttactataaaggaaatgttaaaatttttttcacaataattttttcaattttcactattactgttgtaattattgattgtgattaaaatatttgctcccaggagaactcctgaccagtgggcatgtattcctattttatcctaagattttaatgagcaaaaaggggagagaatttgcaataacttcacaattaccttttctagtgcagttatattagaatgcatatgtttttaaaatgctagtataactagatagtatataatgtacagtataaagaggaatattgtgcttttgaaaagagtatactttttacttttatttatgtactagtagatgtaaaatttcacattgaaggtttatatatattggccaactcatatagaaattttatttataggaagctactactaaaaaaagtcactaactttgtgtacctataatccctaaattaaaattaaattttaattggctggctgtaatttgcattgagagaccttttactagtagctagtgttaggaagtgaacctaaaataagaaaatataatgatctgtgtttatcattagccttgtacaaatgtaaattactaatagtgatgttcttttgcaaggcatagaacatttgtatgaaaagacatttagtatgctttgaaaaaaactcagcttttagtttttttccattagaatactgcaaaacccatatatctttttaaaaaatttatgtactcacagtctttcccttgaagagaagattgaaaaagtctactgttcataaaccatgctaacattttccttttagctagttttgaaagtaaggaacaatacctgggaaataattaaacagaaggttaccattgtcagccagttggctatactgtggttagttctttcagaaattgtaaatatcttgtagcatattctgaaataatagagtaagttcttctcagagatgttaatatcatgtttttcatgttctaattagaatactttattacttacaaactcagaaatacgaacagaaatacagcagacgaacatatttattggtactgaaaagagacgtagtaaattaaatagaagaaatatatttataaagcttagtgaaacacaaaattagaatgttcatgtcaggcacaagggtttggattttgtgcaagctaatttggccacatttggcctggtgacagaactgttcataaggaagtaatatatagataaggtaggtagatatcagttgaatgccttatattgtatacattcctttcaaataaagaccttgagaaaacagcagagccaagtgaagatcacctaaagaactttgtggctaatttatacttcatgtagtagcagtgggtactgggcagggtctctttcccactctgatgatttgtgctcttatttttcctagatttacctcatctagggcatattcttttccctcttcctctttacctttcctggtcctgatccctctgtactcagttcccctaaattattggactacaaactaatatactagaaaagcatacacttattttatttgaatgcagaaatgctatctatcagtatatatacataagaatgtatattacagtatatctatatatacttaacactgtaactttcagtattccccagttagcgtacctaactctcctgtgggtttgttaattcttattagactactagagaaaaaccaactggcagtttgctaagcatatctactggtgttgtttctgcgccctcttttggctaattgatgtaattatactggctctaaagatttactgccccataagtaaatagtatagccacattctgaacatatcaaaagtacaaacttaggaggagtgtatgtacaaaaatgtaaaattttatgaaaatgaacatgtttttatgatgttatttctagttcataagaatgtgatgactgctttgcttcatttatgtacgttcccattatattcttgctgtcaatcaatcacaaatttatatcagattaggataaactaagccattttatgtattttattttaaaccttattttggcagagtaattccttagaattggaaaagctgttactttgaaattaccaatttattacaaaacatagaaatgtattgtagctacaaagacaaccaagcattttctgtgttttaatgaatatctaaaaaactacatttagtttattttactcagttttgaaatgatttttttactggctctattgccttaaaataactaagagattaatgattctttgtataattttccttttctttgttcttttttttacatttcgcagagttatatctatagttttagtaacaatttcttatgtattctggataactgaaaacaactaaaggtgttgggcattagaaaataattgtgagcagtaagattactgatgtaatatgtatgttggactgaagtatttctttataaacattctatttgattttaagcaaaatgtatgttaaagcatgtttttacatcagtaaagtcatttgtcgaccttctggaaatgaaaggtttttacctagatactgtaagttacacctccttaacaatcatatttgtcattgttgttttctgcaaacaaaaatgtttatgggcttcatgtaggcttaagattgtaggcaaaaatggactgagttcaggacccttcaagcagtaggcattcagttacagagcagttggtactttgtaacccagacttacagtttaaaaatatcaagttagctgatgtttcattataataaaaatactattttgcttaagagttgtattacaaatatttgtgcttaacattagaaatagctgttttaaattgtagttaacatattaactttttcagaaaaaaagcatggtttatttttaataatgaaatagagaacataatacgtaatgttcagtataacagctgagttaaaacatctgccaggattaacatcagtgcgtttttgccaatgcatagaggcatttttctctaagtatgatggctaatgataactattctttgttacacattcaagtcactcccatacaagtaactagtgggtgatatgtttcactccaaagggtgtattaattctgaatgctaatcatgaagacttaagttaggacaacacttcaaaccaggaagtgtgaactgattta

SEQ ID NO: 318834 - DNA, 859 bp, Homo sapiens
gcagtgaggtgagatcgcacccctgcactccagcctgagcgacagagcaaaactctatttaaaaaaaaaaaaaaaaatgcattttcctgattcctaatgaggctgagcatatttaaatgtttattggctgttcactggcatttgcgaactcctgtttaaactttttccactttttgctggatctttttcttactgctttgtatttcatttcaatattctggatgctaataatttgttgctagtgctgcatatattttctgctagtttgtgactcatcttcactcatctttcttcatgttgtttcaaaaatagtatcttttaatgcagatattttctgctttattactttgaggttataattgctgtagtgcattgctttttctcttctgaacattttatacactcacctttcacctttaatctaccggtcccaccaaaactaaaatacactgtttctgaatattgtgggtctgtttcaggagtttattgttctgcttgtctattttttttctgttcactaatgccacatcgtctgatactaagtcttgttattttgtagaacaaggacccccaaaactttttagtcttttggctgttcttggctttttgtttttccaagtaaattttagaaataggttgatcaagtctccccgcttccattggtttttttcccctttgttagaattgtgttaaatctaaatcaagttcgggaaaagatatatctcctcaccattgagataaactatccataaataatgttatctgcccaatttttaggtgtttttaaaatattttaataacttactaacgtgttccccataagtcttgtgctttgtttttttgagacagtgtctcactc

SEQ ID NO: 318835 - DNA, 806 bp, Homo sapiens
gcagtgaggtgagatcgcacccctgcactccagcctgagcgacagagcaaaactctatttaaaaaaaaaaaaaaaaatgcattttcctgattcctaatgaggctgagcatatttaaatgtttattggctgttcactggcatttgcgaactcctgtttaaactttttccactttttgctggatctttttcttactgctttgtatttcatttcaatattctggatgctaataatttgttgctagtgctgcatatattttctgctagtttgtgactcatcttcactcatctttcttcatgttgtttcaaaaatagtatcttttaatgcagatattttctgctttattactttgaggttataattgctgtagtgcattgctttttctcttctgaacattttatacactcacctttcacctttaatctaccggtcccaccaaaactaaaatacactgtttctgaatattgtgggtctgtttcaggagtttattgttctgcttgtctattttttttctgttcactaatgccacatcgtctgatactaagtcttgttattttgtagaacaaggacccccaaaaaaataggttgatcaagtctccccgcttccattggtttttttcccctttgttagaattgtgttaaatctaaatcaagttcgggaaaagatatatctcctcaccattgagataaactatccataaataatgttatctgcccaatttttaggtgtttttaaaatattttaataacttactaacgtgttccccataagtcttgtgctttgtttttttgagacagtgtctcactc

SEQ ID NO: 318836 - DNA, 762 bp, Homo sapiens
ctggtctcgaactcccgacctctggtgatctgcccgcctcggcctcccaaagtgctgggattaaaggcgtgagccaccgtgcccagcctaattcttcaattcttaataaacaatttatactgaagagaaaccctacaaacgtgaagaatgttgcaaagcttttaacgtcctcaaaccttactgaacataagataattcataatggaaactagccctacaaatatgaagaatgtggcaaacactgtaaccatttctcacatcttaccacacattaagataattcatactgaagagaaacccgacaaatgtgaagaatgtaacaaagtctttaactggtcttcaactcatactaaatataagagaattcatacagaagataaattttataaatatgaagaatgtgacaaaagctttaaaaacatttcaacccttattacacataagataatttatgttgtagagaaattctacaaatgtgaagaatgtggcaaagttttttttttttttttgaaatggagtctcactctgtcgcccaaattggagtgcaatggtgcaatctcagttcattgcaacctccgcctcctgggttcaagcgattctctggcctcaacctcccaagcagctgggattgcaggcgcctgccaccacgcccagctaatttttgtatttttagtagagacggggtttcaccattttgaccaggctggttttgaactcctgacctcaagtgatccacccgccttggcctcccaaagtgcccca

SEQ ID NO: 318837 - DNA, 1005 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgtagctttcagtcttttaatattttattgcattttattggctatacacacatatccagtcataacacaacttat

SEQ ID NO: 318838 - DNA, 1105 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttatgggaactccaatgtgtgcctgaaaacctccctgaagaaaggttccctaaatacggccgaacctctcagcggtcccaacaaactcgggggcttacacacacaccccacacacgcaccgagaacaacacggggggcgcccaacccagtaaacgaaacggcgacagacggacacaccccaaaactacacccgcgttaaaacacacagcaggagtatcttgccgaggcaccgtatcaccacagcaccgcgagacacagcacgcaaccacgcccgtcgccgc

SEQ ID NO: 318839 - DNA, 504 bp, Homo sapiens
cctgaacatgatcatgccactgcattccagcctgggtgacagagctagacactgtctcaaaaaataaatagatgacagatagactctttgcactactgttgacaaaacttcctctgtttttagcttactcttgaacaggatgttgattgaaataaaccttgttacttgagtatgaattaagtagtcttcaggttgtaactgctgtgatcagagcagttgtagtttatcctgtacttggtaggacaagatgctctagaggttccccagttttggagattagtttccttggtagcaaggttacaatgttgaagcctttttctaattatgttttttttttatgatcctttattctgttgtagggcattgacactgagaggcccattctgcaagtggacagctgtgtctttgctggggagtatgaaggtaggaggatgtcagatagatggactctttctgatatgggcttttcagagatggtagctcttctcaacaatttgcctttgt

SEQ ID NO: 318840 - DNA, 406 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagagcccattctgcaagtgacacgaatgttcggtaccgaactcga

SEQ ID NO: 318841 - DNA, 790 bp, Homo sapiens
gacccacgcgtccggacccacgcgtccggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgtagctttcagtcttttaatattttattgcattttattggctatacacacatatccagtcataacacaacttat

SEQ ID NO: 318842 - DNA, 1016 bp, Homo sapiens
cctgaacatgatcatgccactgcattccagcctgggtgacagagctagacactgtctcaaaaaataaatagatgacagatagactctttgcactactgttgacaaaacttcctctgtttttagcttactcttgaacaggatgttgattgaaataaaccttgttacttgagtatgaattaagtagtcttcaggttgtaactgctgtgatcagagcagttgtagtttatcctgtacttggtaggacaagatgctctagaggttccccagttttggagattagtttccttggtagcaaggttacaatgttgaagcctttttctaattatgttttttttttatgatcctttattctgttgtagggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgtagctttcagtcttttaatattttattgcattttattggctatacacacatatccagtcataacacaacttat

SEQ ID NO: 318843 - DNA, 879 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaattatggaaactcaaatgctgccttagaaatcactcctagatgaaatgtttctcataataacttgtcaagaactttttagagttgttacataaaaataattgctgtgt

SEQ ID NO: 318844 - DNA, 726 bp, Homo sapiens
gcgtttacctgattgacgtcaagttcaacggcacccacatccctggaagccccttcaagatccgagttggggagcctgggcatggaggggacccaggcttggtgtctgcttacggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaattatggaaactcaaatgctgccttagaaatcactcctagatgaaatgtttctcataataacttgtcaagaactttttagagttgttacataaaaataattgctgtgt

SEQ ID NO: 318845 - DNA, 933 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgt

SEQ ID NO: 318846 - DNA, 1125 bp, Homo sapiens
  misc_feature (957)..(971): n is a, c, g, or t
  misc_feature (976)..(977): n is a, c, g, or t
  misc_feature (979)..(979): n is a, c, g, or t
  misc_feature (985)..(985): n is a, c, g, or t
  misc_feature (987)..(988): n is a, c, g, or t
  misc_feature (990)..(990): n is a, c, g, or t
  misc_feature (994)..(994): n is a, c, g, or t
  misc_feature (1005)..(1005): n is a, c, g, or t
  misc_feature (1041)..(1041): n is a, c, g, or t
  misc_feature (1062)..(1062): n is a, c, g, or t
  misc_feature (1066)..(1067): n is a, c, g, or t
  misc_feature (1082)..(1082): n is a, c, g, or t
  misc_feature (1084)..(1085): n is a, c, g, or t
  misc_feature (1089)..(1089): n is a, c, g, or t
  misc_feature (1095)..(1095): n is a, c, g, or t
  misc_feature (1106)..(1106): n is a, c, g, or t
  misc_feature (1109)..(1109): n is a, c, g, or t
  misc_feature (1112)..(1112): n is a, c, g, or t
  misc_feature (1116)..(1116): n is a, c, g, or t
  misc_feature (1119)..(1119): n is a, c, g, or t
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgtaaaaaaaaaaaaaaaaaaaaaaannnnnnnnnnnnnnnggggnnanaaatananngngggnttaaattaatnaaaagtattatattttaaataaaatttatatttttnttttttttttttttttttttntaannttaaaattttttttnannatanattttngagtatttttnatnaanattntanattaat

SEQ ID NO: 318847 - DNA, 530 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatccagaaaggcaatattaaaacacgggcctaaaaattaataaataagcccccttcccacacaaatttgg

SEQ ID NO: 318848 - DNA, 853 bp, Homo sapiens
cccactgctcctcaccggcttcttgctcctgggcgcgaggagccgggcagcttgggaccttagccctaatcgtcaccccgtacttgggatgggaagtaccgggaagttaccttaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgtagctttcagtcttttaatattttattgcattttattggctatacacacatatccagtcataacacaacttat

SEQ ID NO: 318849 - DNA, 1000 bp, Homo sapiens
tctccacgtgggtaccggcgctctcggcgcccgtagccacccgcccgccggaagccgacatctcgagttctggcagaagcaatttgcgcggcgaggagcggagcggcaggaacccaataagctgcttcgcctcggagctgaagcccgtactcaagatggcggctccgggcgggcgtggccagtgactagaaggcgaggcgccgcgggaccatggcggcggcggcggacgagcggagtccagaggacggagaagacgaggaagaggaggagcagttggttctggtggaattatcaggaattattgattcagacttcctctcaaaatgtgaaaataaatgcaaggttttgggcattgacactgagaggcccattctgcaagtggacagctgtgtctttgctggggagtatgaagacactctagggacctgtgttatatttgaagaaaatgttgaacatgctgatacagaaggcaataataaaacagtgctaaaatataaatgccatacaatgaagaagctcagcatgacaagaactctcctgacagagaagaaggaaggagaagaaaacataggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttttagagttgttacataaaaataattgctgtgttaattaacctcgctgcgccccttctgttttttcctgaaaataaatactgggccttgttggcctcagg

SEQ ID NO: 318850 - DNA, 361 bp, Homo sapiens
tttgtttattcctcatcccctccaaattaggtggggtggaatggctgcaaataaaggataatgatttctcctatcgacccaacatgatttgtaactttctacatgaaaatgaagacgaagaagtggtagcttcagccccagataaatctttggaattggaagaggaagagattcaaatgaacgacagttcaaacctgagttgtgaacaggagaaaccaatgcacttggaaatagaagattctggtcctcttattgatataccttctgagacagaaggttctgtttttatggaaactcaaatgctgccttagaaatcactcctagatgaaatgtttctcataataacttgtcaagaactttt

SEQ ID NO: 318851 - DNA, 3288 bp, Homo sapiens
  misc_feature (6)..(6): n is a, c, g, or t
  misc_feature (8)..(8): n is a, c, g, or t
  misc_feature (13)..(13): n is a, c, g, or t
  misc_feature (1282)..(1282): n is a, c, g, or t
ggctgnantcagnctggcagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcngcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaactgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttccc

SEQ ID NO: 318852 - DNA, 2327 bp, Homo sapiens
  misc_feature (6)..(6): n is a, c, g, or t
  misc_feature (8)..(8): n is a, c, g, or t
  misc_feature (13)..(13): n is a, c, g, or t
ggctgnantcagnctggcagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccacttcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaatatgtaaaatatgcttataaatcagaaaaataaattgtttctcactaagtcaaaaaaaaaaaagctcatgtttccaccacaa

SEQ ID NO: 318853 - DNA, 801 bp, Homo sapiens
  misc_feature (6)..(6): n is a, c, g, or t
  misc_feature (8)..(8): n is a, c, g, or t
  misc_feature (13)..(13): n is a, c, g, or t
ggctgnantcagnctggcagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagtacggtgataacaactccttgcccgtgtagaaattgaa

SEQ ID NO: 318854 - DNA, 5142 bp, Homo sapiens
  misc_feature (6)..(6): n is a, c, g, or t
  misc_feature (8)..(8): n is a, c, g, or t
  misc_feature (13)..(13): n is a, c, g, or t
  misc_feature (1282)..(1282): n is a, c, g, or t
ggctgnantcagnctggcagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcngcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaactgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaatatgtaaaatatgcttataaatcagaaaaataaattgtttctcactaagtcaaaaaaaaaaaagctcatgtttccaccacaa

SEQ ID NO: 318855 - DNA, 780 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaaggttgaagtacaatggcacaatctcggctcacctcgacctctgcttcctgtattcaagtgattcttctgcctcagcctcccgagtagctgggattacaggcatgcgccatgacacttggctaatttttttgtgtgtttttagtagagatggaattttgccatgttggccaggctggtctcaaactcctgacctcaagtgatccacccacctcgacctcccaaagtgctggtattataggcatgagccaccatgcctggcctcatttatttttaaatagctgcagtaatcccggctttagataaaccacatgaactaataatatcactagtgttcaaaggtagaattatatgtgtaccatatgtattgctattaaataaagtcaa

SEQ ID NO: 318856 - DNA, 424 bp, Homo sapiens
cggccgcaaatgttttttagaaaggtaagaaaataaattttactgtctccatttctttttaattaatagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggtatcccatttcagattgaccaatgagatatagatttatgaggtgataaagtggtacgttgcgatagctcacagcaaccttctagagaattttaagctagagatcgtagctaaaggactaggtccagaatcataaaggtgatttgatttacctgcaagatgttgttttttaaggtcataaccatgtgggat

SEQ ID NO: 318857 - DNA, 780 bp, Homo sapiens
  misc_feature (16)..(16): n is a, c, g, or t
  misc_feature (36)..(36): n is a, c, g, or t
cacatatgatatgttnatctttacaatacctgatanagattcagctgtctggcacttacacatgtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaaagaaagaagcatagaataagacaaagaaacaagccagggagcggttgcgaccctgacaattatttcgcccctcgcacgggcgcccacaatgttgacgcgcttcgcctgttcttctctttgtcacacatgggtggccctcctatgtggatgccgcaaatttactagagcactaggctcgtgggacccgtgtgttatccagagtggcagcaacgggaggaaagcggcatacttggggagtctattcggccaccgaaagagcctatatcattcctcgaggcggcgcggcactaaattcggcgtagagcatatcattccaatgtgttcttaaacgcgcctgctaggagttacacctattgcgattgtgtttagcggcgtttaaatctgagcgggctaaacatcgatgacgcgggaatgtatcgcgttcgatgcgcatacaaaagtcttggctgtacggggacctcttggttctttgacgattcttgttcccggagtgcttctttatataaacgaaccggatgcagccttttggattgagactatagggtataccccatattcca

SEQ ID NO: 318858 - DNA, 220 bp, Homo sapiens
  misc_feature (16)..(16): n is a, c, g, or t
  misc_feature (36)..(36): n is a, c, g, or t
cacatatgatatgttnatctttacaatacctgatanagattcagctgtctggcacttacacatgtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318859 - DNA, 4962 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataagtaagtgataacattgcttatacttactgcccatcgtatacactgtagtccttttaatgtcagtttatgacatctaggctaaatttagaggatgtagtcattttttttttggctgaagtatttcttcctttgatttttgaagtcttagctatgggaatgaattcagtgtggaattgttttcatgtttttccccttacttgtctttgtgaaactttctcttttgttgctttttttctctttgaattctcttgtttagaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318860 - DNA, 3931 bp, Homo sapiens
gtagcagagtaatgtgtattctttttatcatgattaataatatgcaaattgaattgaataaactttcagtccatgagaatgttttgtcatttccccacctttgtgtctctaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318861 - DNA, 3372 bp, Homo sapiens
cagctttattaaattgtggataataaaatatcaaatttcttttccactttacctacttaggtataagacagagctttctgttgaagaatgaaaagtagaagcagtctaggagaactgcagctcgattaggtgtgaacaaaaataatcatcgctattatctggctgtcttcatttcagttgaatactatgacctgtgtgcagtaatgaaaacattcacttaaactctttattttaaggtcataccagtgcttggtgaaagtataaatgaatcatgagtaatctaaattgtaaggaagattatttgactgttttatttaagctgtgttttggatgcattttacagccaaccaaaccaagtcgctaaatttttttggaaagatgtaacatttttaaatggaaaaaaggaaaaaaatactcatctttaatttttggtctttttcgtgccagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318862 - DNA, 2047 bp, Homo sapiens
taatttgatggggcttgttcgcacaaagaaggaagagctagcggcagcgactctcttattctccccgctacatattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318863 - DNA, 2223 bp, Homo sapiens
acgcgttactccgggcggtgggattctctagagtcgtgctggagtggcttgcctgttaggtagtgggccgctcgttttgcacgtttcgctgattggggacattacctggcacatcgcggggactcagtaagtcctgttggttggactcagtaagtcctgttggttgaatgaaggcataagcgtccccttaaatttacttagagaatcttttcttagtttgaacttatttcatccccttctcagatttaaaatgtgaaaggtcagtgtacttttgtcatctgtctgccaagtaaagccaagaataccaaatatactcaaatggagaaaagtatgttcttatctcttttattttaaaggagatatttgaagtatcagtactcagcatcagtttgtgagaaaattactgtgaccagagattggaatttttggtgtattgtgacccttagaatctagaatacagtgtagtacaacttaggtgcagcccatgttacatgacatgtagctgttgaagatgattttgatgtatgtaaaattaagcatattaatctaagaatctctctccacattcgtaggatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318864 - DNA, 2347 bp, Homo sapiens
tcggctccccctcgttacctgacagtcattctatccttttctgtttgttttcttcctatcagatgtcagcatctggtctgttctttacctattctagcattacctggcacatcgcggggactcagtaagtcctgttggttggactcagtaagtcctgttggttgaatgaaggcataagcgtccccttaaatttacttagagaatcttttcttagtttgaacttatttcatccccttctcagatttaaaatgtgaaaggtcagtgtacttttgtcatctgtctgccaagtaaagccaagaataccaaatatactcaaatggagaaaagtatgttcttatctcttttattttaaaggagatatttgaagtatcagtactcagcatcagtttgtgagaaaattactgtgaccagagattggaatttttggtgtattgtgacccttagaatctagaatacagtgtagtacaacttaggtgcagcccatgttacatgacatgtagctgttgaagatgattttgatgtatgtaaaattaagcatattaatctaagaatctctctccacattcgtaggatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaagttgccttctgatttctgcatcattccagcccttctctgggcagccaggatccatcaggcagcatttgccgagtctgccctgcagactctggccgagcgacggatgaaaggagtgctcagacacagtgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318865 - DNA, 1717 bp, Homo sapiens
agagtaaagcattacatttatttgtcctagtcatgaactgaaagttttaagacataacctctgggtatacacatagacaaatgtgtaatgattactatttataagaaaactgaaaactcaaaagtcgtttacctgattaagagttatatagctaaaaaaatttagaatagtgattaacctttcaactctgttgcttctggcattccgtttcaaccaggtgcagctaccctaactcatttaatctatatgtgtaatatagtagctcatttgatgtttattaataaggcatcatatttgatgtacaatacaattgtacgtacctggatatacagtatttctgcattataaatcttaggcaaaagaatacatgaatttaaattcagataagaatttacttttaaagacattttactgatatctgaaatattttttaatttgctgtacagtgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318866 - DNA, 1332 bp, Homo sapiens
  misc_feature (28)..(28): n is a, c, g, or t
  misc_feature (31)..(31): n is a, c, g, or t
  misc_feature (37)..(37): n is a, c, g, or t
atattcgtcgtgactgggtacgacctgncgntgatcnggcctgatgcagtactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318867 - DNA, 3469 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagtaggtttttaaatgtattttaattctttaaatgtttagttctattttcccaactataacaatattgtgtatatatacatagaccgtatttaaaattattaacagcagttggtaggattataggtgcttttaaattttcctctttttatataaatgtgtaatttatttaaattataaatatataattttgtgattaaatgttttaatttttattttaatcactctaatttgttcttggaagataattttattggaaagtata

SEQ ID NO: 318868 - DNA, 385 bp, Homo sapiens
ttttactgatatctgaaatattttttaatttgctgtacagtgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggtaacgtttctgcttcttgtttcagcaaagttcttggggttacctcacagacctctcttgtgccccattgctggttaaaagaggaagaagataaatggaaagaatctacgctgggctctgaatatgacatgtttagc

SEQ ID NO: 318869 - DNA, 4706 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318870 - DNA, 4961 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaagttggtcttaatttttcataaataaaatttggggttataacagaaataatacattaaatacatagacaaaaaaagttaaacataagataatctattttacagtgtttcttataggcttacaattatttgaatgtatttccagttcttgtatgattaacttttgtgcatatctaactttttattatttttatctttggctactgcacgtgcatctctcgtcattcctccaccaaataaacagacaaaagtagtatt

SEQ ID NO: 318871 - DNA, 4627 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataagatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318872 - DNA, 4375 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagaaaaaaaaaagaaaaaaaaggcaggaccgctcaaaaggaatacccgcaaggggcccaaagataaagagcatccaagacataactggtacaaaggtggaccacaataggacagagcaataaaaaggcagagcaaggacgtcgaaaacaaagcagtgacagggagaaaaatggacagcactgggaaaacactgggagaacaggaacacaacacaccggagagcggacacaaaatggggcaagaacaaccaccggaacatcaaggcccacacggaaatatcaaacataaagaggagagcaaagcagaagacacaacagcgatagcatacaggagaaagttggacaacggacacatagcggagaaatcttccacggagcgtaata

SEQ ID NO: 318873 - DNA, 2221 bp, Homo sapiens
tcggctccccctcgttacctgacagtcattctatccttttctgtttgttttcttcctatcagatgtcagcatctggtctgttctttacctattctagcattacctggcacatcgcggggactcagtaagtcctgttggttggactcagtaagtcctgttggttgaatgaaggcataagcgtccccttaaatttacttagagaatcttttcttagtttgaacttatttcatccccttctcagatttaaaatgtgaaaggtcagtgtacttttgtcatctgtctgccaagtaaagccaagaataccaaatatactcaaatggagaaaagtatgttcttatctcttttattttaaaggagatatttgaagtatcagtactcagcatcagtttgtgagaaaattactgtgaccagagattggaatttttggtgtattgtgacccttagaatctagaatacagtgtagtacaacttaggtgcagcccatgttacatgacatgtagctgttgaagatgattttgatgtatgtaaaattaagcatattaatctaagaatctctctccacattcgtaggatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318874 - DNA, 1721 bp, Homo sapiens
aggcagctgggtcctgaaagagctagcccaagcaatagacctgtttccttttcccagtctcatgtttcacgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaagacttaatgaaattgttgatgcggcaaatgctgttatttctcatatagatcaaacagccctagcagtttatattgcaatgaagactgatcccaggcctgatgcagctactataaaaaatgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggttttgacatttgcatataaacatgcattagtaaataaaatgtatgggagaggccttaaatttgcaactaaacttgtggaagaaaaaccaacaaaagaaaactggaaaaattgtattcaactgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaatttttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaa

SEQ ID NO: 318875 - DNA, 3387 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtctgaaagctaataacattgactacacagttcattcagtcagaagagctctagaaaacactgcagtgaaggctgacaatatagaagtatttgctcaaggacatggtattattcaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtatgtggctatgatatagcatcccctaacgcaggtccgctcttcagagttccgatcactgcagttatagcagcaaaagtaaatgaatcatcacattatgatctagcctttacagatgtacactttaaacctggtcaaattcgaaggcattttattgaggttcctgagggtgcaacatgggctgaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctaggtggaaaagcaattgaattttgcattgctcgttggtgggcaagtctcagtgatgtcaacattgattataccatttctttccatgggatagtgtgtactgctcctcagttaaacattcatgcatcggaaggaatcaaccgctttgatgttcagtcctccttgaaatacgaagatctggctccctgcataactttgaagaactgggtccaaacactgcgcccagtgagtgcaaaaacaaaacctttaggatcaagagatgttttgccaaataaccgtcaactttatgagatggtcctgacatataactttcatcaacccaagagtggggaagtaactccaagctgcccactactttgtgaactattatatgaatctgaatttgacagccaactgtggattatttttgaccagaacaaaagacagatgggttcaggcgatgcctatccacatcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataaaatacctaaaggggcaggacctggatgctatcttgcaggatccttaacattgtcaaagactgaactaggaaagaaagctgatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagctggattctagtgacatttataacgaattgaaagaaacatatcctaattatcttcctctgtacgttgcacgacttcatcaattggatgctgaaaaggaacgaatgaaaaaacttaataaaacttgatgcggccaggcctcctccccttccgtccccccggggtgacatggaataagtgg

SEQ ID NO: 318876 - DNA, 1596 bp, Homo sapiens
ccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggttacaactgatggaaaaccaaaaatcgttgatatcattgatacaacaggaagtggcgatgtgaatactgctacagaagtagagccaaaggatggtgagattgttggcctttcaggaagagtgcttaagattcctgcaagctggacaaatccctcaggcaaatatcatattggcataaaaaatggctatgacttctatcctaaggcactcaaggaaaggatacagaaagaacggaaggaaaaaatctgggaccctgttcacagagtggcccttgcagaagcctgtagaaaacaggaagaatttgatgttgccaacaacggctcttctcaagcaaataaactaatcaaggaggaacttcaaagtcaagtggaattgctaaattcttttgagaagaaatacagcgatcctggccctgtatatgactgcttggtatggcatgatggcgaagtctggagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagtggaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctatgatagaagttataaatcataagtgtgatcttgtcaactacagttacggagaagcaactcactggccaaattctgggagaatttgtgaagtaattaatgaagcagtatggaagcataatataatttatgtttcaagtgctggaaataatggtccatgcctgtctacagttggttgtccaggtggaactacatcaagtgtgataggtgttggtgcttatgtttctcctgatatgatggttgctgagtattcactgagagagaaattacctgcaaatcaatatacttggtcttctagaggacctaggtggtttcctctttaaaaaataaacttatcttagtagcttattataaagtgtcattgaaaacaaccaggccgtggatatccacatggatcagaaagctttgctttgcgctgtcattgtagactgcccctgccagcccagctaaagacactcaataagagtggcttaggagaagagccaaaagtcagcaaagcttgatgtgtttttgttcagttaataaaagtgtaaaattattaaacttattctcttct

SEQ ID NO: 318877 - DNA, 472 bp, Homo sapiens
agggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagct

SEQ ID NO: 318878 - DNA, 2072 bp, Homo sapiens
gtcacagggtctctggtctgcacacctcccttactgggctttttctggcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagccgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcctctgtgtcctaaaagggaccctcctgtggtttttgtcttgattttttttaataaacggtgctatccccgca

SEQ ID NO: 318879 - DNA, 2874 bp, Homo sapiens
acagtgagccgagatcatgccactgcactcctgcctgggcgacagaaaaagactctgtcccaaaagtgggctctttgaaggctagaaggtatttggggcagcagacttgtgtggaagcagttatcaaagtggggatgtgacacgcaccaggagaggggaacagacaacacatgagattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagccgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcctctgtgtcctaaaagggaccctcctgtggtttttgtcttgattttttttaataaacggtgctatccccgca

SEQ ID NO: 318880 - DNA, 448 bp, Homo sapiens
aaatctttgcttgctttttacatgagcctggcccttagttaaccttttcttgtggctacacaaagtatgctcactggttactaatgacttgggatgcatttgtcaaactgattatattagttttctagggatgccataacaaagtagcacagaccagatggctcaagcagcagacatttattttctcacagttctagaggctagaagttggaggccaagatgtcagcagggttggtttcttctgaggcctctctccttggttgcagatggtcatatctcactctgtcttccgtggccttccttttgtctgtgtcctaaatctactcttctgataaggacatcagtcatattggaataggacccaccctaatgtcttcattttaatcacctctttaaagcccctacctccaaatacagtcacactgtgagaaactgagggttaggaagt

SEQ ID NO: 318881 - DNA, 2907 bp, Homo sapiens
catggacagtagcacctggagccccaagaccaccgcggtcacccggcctgttgagacccacgagctcattcgcaatgcagccgatatctccatcatcgttatctacttcgtggtagtgatggccgtcggactgtgggctatgttttccaccaatcgtgggactgttggaggcttcttcctggcaggccgaagtatggtgtggtggccgattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagagctcatgattgccggaaggttgtttatcctggtgctgattggcatcagcatcgcctgggtgcccattgtgcagtcagcacaaagtgggcaactcttcgattacatccagtccatcaccagttacttgggaccacccattgcggctgtcttcctgcttgctattttctggaagagagtcaatgagccaggagccttttggggactgatcctaggacttctgattgggatttcacgtatgattactgagtttgcttatggaaccgggagctgcatggagcccagcaactgtcccacgattatctgtggggtgcactacttgtactttgccattatcctcttcgccatttctttcatcaccatcgtggtcatctccctcctcaccaaacccattccggatgtgcatctctaccgtctgtgttggagcctgcgcaacagcaaagaggagcgtattgacctggatgcggaagaggagaacatccaagaaggccctaaggagaccattgaaatagaaacacaagttcctgagaagaaaaaaggaatcttcaggagagcctatgacctattttgtgggctagagcagcacggtgcacccaagatgactgaggaagaggagaaagccatgaagatgaagatgacggacacctctgagaagcctttgtggaggacagtgttgaacgtcaatggcatcatcctggtgaccgtggctgtcttttgccatgcatattttgcctgagtcctaccttttgctgtagatttaccatggctggactcttactcaccttcctttagtctcgtcctgtggtgttgaagggaaatcagccagttgtaaattttgcccaggtggataaatgtgtacatgtgtaattataggctagctggaagaaaaccattagtttgctgttaatttatgcatttgaagccagtgtgatacagccatctgtacctactggagccgcagaagggaagtccactcagtcacatccagaaaaaggcagactaagaatcagaagccatgtgattgatgtctgacgtgagtctgtctcaggtagattccgggtgtcagtgtggtttataatccttgaatattgttttagaaactttggtctccctggttcctgccacttttcctgtccgtcctcctccccattttttttttaaaagaaagctgttttcccctcatcatatccctcttgagttttgcctggactttccctctcaagtgtgtcaatcaggtaaactgaggaatgcatggaagctgaggatggagcttgatgggctccctgtcctgggtgtttgctctctgaagtggaggcctgaggaaggtagtacttccacaaaagggagggacccgggccccagcctcaagctagtgggggaggcagatagcctgaatccaggggattttctgggcttcttaaaatgtccattgtgagttccccgtgtttgggattccactcattttggcattcacagtgcctggaatgtcttagattttcagcaatgcgtgttgaataaatgaatgacataggcatttatttttaaatctttgcttgctttttacatgagcctggcctctgtgtcctaaaagggaccctcctgtggtttttgtcttgattttttttaataaacggtgctatccccgca

SEQ ID NO: 318882 - DNA, 1529 bp, Homo sapiens
acagtgagccgagatcatgccactgcactcctgcctgggcgacagaaaaagactctgtcccaaaagtgggctctttgaaggctagaaggtatttggggcagcagacttgtgtggaagcagttatcaaagtggggatgtgacacgcaccaggagaggggaacagacaacacatgagattggagcctccctctttgctagtaacattggaagtggccactttgtggggctggccgggactggggcagcttcaggcatcgccattggaggctttgaatggaatgccctggttttggtggttgtgctgggctggctgtttgtccccatctatattaaggctggggtggtgacaatgccagagtacctgaggaagcggtttggaggccagcggatccaggtctacctttcccttctgtccctgctgctctacattttcaccaagatctcggcagacatcttctcgggggccatattcatcaatctggccttaggcctgaatctgtatttagccatctttctcttattggcaatcactgccctttacacaattacagggggcctggcggcggtgatttacacggacaccttgcagacggtgatcatgctggtggggtctttaatcctgactgggtttgcttttcacgaagtgggaggctatgacgccttcatggaaaagtacatgaaagccattccaaccatagtgtctgatggcaacaccacctttcaggaaaaatgctacactccaagggccgactccttccacatcttccgagatcccctcacgggagacctcccatggcctgggttcatctttgggatgtccatccttaccttgtggtactggtgcacagatcaggtcattgtgcagcgctgcctctcagccaagaatatgtctcacgtgaagggtggctgcatcctgtgtgggtatctaaagctgatgcccatgttcatcatggtgatgccaggaatgatcagccgcattctgtacacagaaaaaattgcctgtgtcgtcccttcagaatgtgagaaatattgcggtaccaaggttggctgtaccaacatcgcctatccaaccttagtggtggagctcatgcccaatggactgcgaggcctgatgctatcagtcatgctggcctccctcatgagctccctgacctccatcttcaacagcgccagcaccctcttcaccatggacatctacgccaaggtccgcaagagagcatctgagaaagaaactctgtctagccacagtgtggggatggggagctcccgccgacagactctgttgctttctggcttggccgctggttgtcccttgctcctggaaggtcaccatattgatgccaaactcagtgtggatgcccaattggtagagtgcactacagcccagaactcatggactcaagtcagcctcccaagtccctgggactacagattcctgaatgatccggcggcatggcagaggtggtgcctactgatatggctccgatgactggaggaacaccagggtccttggtcttgcgccaatgtag

SEQ ID NO: 318883 - DNA, 1550 bp, Homo sapiens
gagcccagccggccaacgcctggactctggccgagagactctcggcagcaaatccagtggagccccccgacttctgacaccagaaaccgtctgtgagtgcaggtctgcgttctcaagccgctaaactcacggagatttctacgcagctgcagaagatgaatgcatctcccttctacgccttctgctgtggcggccgtgagtgttaacccactgcttctaaacccgtgaagcctgtcatgtgacgctgatgtcctgtgactctggtggtccctaccccccaaggcctccacacccccctctctgtgctgtgttctgtgggccacggccacccctcatcagagcagccccctggggatcccttccagtggttggaagcaaacactttctattttcctgtgtctggaaatgcttgtattttgacttcatttttacaggatatttttcctggatataagatagttggttactgagcaatgacataaattacaatattattgacttcaagcccaaaggaaaaatgaatatacaggagtccacgttgatttgattaatgattgaatatgtaaattcataagaaggggcaactcttaactacagaaaaattccaatggataaatgtaaaaggaataagggaaatagaaaatcattgttatgacattacagtaataattgctgctgtcaccactgataaatgctaaaattagtggacagaattttaaggaaaaacaggatatttacgtaactcaacatagcagttattgcagtggctgtagcatgcgtcctcaccctcatttatctccctgtttctaggagacggagcttaatgtcactccccttgagtgtggactgaatttagtgactcaatttccaagaattgagcaagaaaagggaaaaataataactttatgttggagaaatgcacagagttcaccttgcccaagtgatcaaaggtgacttcacagtggtaagtcaggacaataccctgcaccctgacgtgatgtcgtgaaagggcactggcgtacgtggtattctctccacaagtccataacccacggcaattgtgagtaagcctcagacaaacccccaccgcgggtcactctccgacattgctggcaatcctcttcaagagtgtgcaggtcatgaaaggccaggacacactgagaaagggtcccagatgtgaggagacgaaggagatttgacaggagaagcatgatgggatcctggaacagagcaagaacgttagtgaagaacaggtgaaatgctgctagagcctgttggttctttgataatagcgtaccaaaaacaattttttagttttgataactgtaccatggttatgtaatacattaacactggggaagctcagtgaatatgtggactcttggactatttttataacgcttcttgtgtagaaggtctaaaatgatctcagaatacaaatttaaataaattaatttaatgctcaaaacacccttgattggaacttacagctggccctctgtattcgtgggttcaaccaatcactaattaaaaatattggaaacaaaaat

SEQ ID NO: 318884 - DNA, 728 bp, Homo sapiens
gcctggaaacacatgatggggttcaggaggaagtgaaagatcagttatatcaaatgacacttactgagatttgatcgctagattggcaatgtagaagccactggtgaccttgtgagagcactgatggggaggagtgggagcaatgcctaattggagtgggtttgtgagagaacaggagagaaggaattggagaccataggaactcttgaggggttttgctgtagaggggagcagagccatggcaacaactgtaaggggaaatagtgggtttttgtttcgttttgtttaagatgggagaagattatagtgtgcaggtcatgaaaggccaggacacactgagaaagggtcccagatgtgaggagacgaaggagatttgacaggagaagcatgatgggatcctggaacagagcaagaacgttagtgaagaacaggtgaaatgctgctagagcctgttggttctttgataatagcgtaccaaaaacaattttttagttttgataactgtaccatggttatgtaatacattaacactggggaagctcagtgaatatgtggactcttggactatttttataacgcttcttgtgtagaaggtctaaaatgatctcagaatacaaatttaaataaattaatttaatgctcaaaacacccttgattggaacttacagctggccctctgtattcgtgggttcaaccaatcactaattaaaaatattggaaacaaaaat

SEQ ID NO: 318885 - DNA, 1278 bp, Homo sapiens
gagcccagccggccaacgcctggactctggccgagagactctcggcagcaaatccagtggagccccccgacttctgacaccagaaaccgtctgtgagtgcaggtctgcgttctcaagccgctaaactcacggagatttctacgcagctgcagaagatgaatgcatctcccttctacgccttctgctgtggcggccgtgagtgttaacccactgcttctaaacccgtgaagcctgtcatgtgacgctgatgtcctgtgactctggtggtccctaccccccaaggcctccacacccccctctctgtgctgtgttctgtgggccacggccacccctcatcagagcagccccctggggatcccttccagtggttggaagcaaacactttctattttcctgtgtctggaaatgcttgtattttgacttcatttttacaggatatttttcctggatataagatagttggttactgagcaatgacataaattacaatattattgacttcaagcccaaaggaaaaatgaatatacaggagtccacgttgatttgattaatgattgaatatgtaaattcataagaaggggcaactcttaactacagaaaaattccaatggataaatgtaaaaggaataagggaaatagaaaatcattgttatgacattacagtaataattgctgctgtcaccactgataaatgctaaaattagtggacagaattttaaggaaaaacaggatatttacgtaactcaacatagcagttattgcagtggctgtagcatgcgtcctcaccctcatttatctccctgtttctaggagacggagcttaatgtcactccccttgagtgtggactgaatttagtgactcaatttccaagaattgagcaagaaaagggaaaaataataactttatgttggagaaatgcacagagttcaccttgcccaagtgatcaaaggtgacttcacagtggtaagtcaggacaataccctgcaccctgacgtgatgtcgtgaaagggcactggcgtacgtggtattctctccacaagtccataacccacggcaattgtgagtaagcctcagacaaacccccaccgcgggtcactctccgacattgctggcaatcctcttcaagagtgtgcaggtcatgaaaggccaggacacactgagaaagggtcccagatgtgaggagacgaaggagatttgacaggagaagcatgatggcttgggtagcctgagcgggccctctattttctttgtgtggagggtgggtgtgggggaaagcg

SEQ ID NO: 318886 - DNA, 680 bp, Homo sapiens
gaattggctctgtcattgcttagttgaaagaccttaagttactgtctttctctaagcctttaaattttaaataagatattgaacttggctctgtcttgtcccaaatttttataatcctagaagagagtcagccttcaatatattcattttagagatatttagtatactgacatattacttaaaatagcagatgggaaaaattaaatataatctcatagatttatgtggaaaattcaacatcatcttagagttctggaaattgtgtttaactttaccatttatagaaactatgttagatttcatttctcttactctttgtcagatcgacaccttgactgtgtgagacgtgattaacaaaaaggaaaactacccccactggaagttgttaaaggaaaggcaatgcaaatgaaaaaaaagaaaaagaatttctaaaagttttatcagacaaaaatttaattgaatcaatggggcaatctggagttctggatgattctgttaattgaagtttacaatcacttttattttatttttatttatttacttattttgagacagagtctcactctgttaccaggctggaatgcagtggcgcgatctcagcttactgcaacctccgcctccctggaccaagcgattctcatgtctcagcttcctgagtagctgggattacatgcgtgcac

SEQ ID NO: 318887 - DNA, 2608 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtctctctagtagttaaaacagctattttagtaaccccaagagtttcttctcatatccataaaattggattacagtatggcaatatctacagcttctattcattatgcaacgtttaacattgattggataaatgcttataggctgggccaggtggctcccacctgtagtcccagcactttgggaggcaaaggcgggaggatcacttgaggccaggactttgagaccagccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacttggcaaaaaattccgcactatataattcgcacacattaattagggtttatgtaccatacaaaaaaaaattaattagggct

SEQ ID NO: 318888 - DNA, 730 bp, Homo sapiens
  misc_feature (722)..(724): n is a, c, g, or t
  misc_feature (726)..(728): n is a, c, g, or t
ctcttgccggttacccggcttttcgaagttattcggcccccctatgggagccccgccgatttccccccttgaccccggaaactgggtccgggacacgctttgcccccgggccccttccgtacccctttttccccccccccccttgatccccccggtttttttttttttttttttttttttttcagactgaccgcggggcagctgcggagcatgtcgaccccggcccggaggaggctcatgcgggatttcaagcggtaagggccttcaccttcgcctagatgacggcccctcaaagctgcggggctgcagggcgtggatcccagacaccttcccctttgtgaccctcagagggccggctgtgggcccagcgggactggcggaagccgggtcctagcctcggccctactcccataagctttgccgctcgttctggcgcccgaagaaattttgatactgcttcccctccccacaaaaagtaaaacggtgtcgatcgactggtctagggttccctgctgcccatttcggccagctgcccggcgtctcgcccaggcgatcagacattatccgcccgcccctgcaccctgcggcgcccccttcttgtcccctcaaagtgagctcctgcgggagcttgttcctctccggcagcaccagtcagctttgtttcacggccccgccgtcttctccgaggagccgtgttggggcgaacccctctcccgactccnnncnnncc

SEQ ID NO: 318889 - DNA, 1187 bp, Homo sapiens
gtatatacccagtaatgggatggctgggtcaaatggtatttctagttctagatccctgaggaatcgccatactgtcttccacaatggttgaactagtttacagtcccaccaacagtgtaaaagtgttcctatgcatcaattcttgaagagataatattgaaagagggatgattctcaagccctttcaatttttagataatttggagaggtatttaataagtatatatacctggttaatatatttaagtcatatggttcattttagttcacaataacaaggaaatggagttagtctgtgtctcaaaatagatggtatagtgtctgtaggtgtttacgtggcctccttagtggccttaatgttcaactttttaaattaccacgctggatttccaggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactgcaagataaattagaaaaaaaaaatatttcaattagagttttggcccagcacagtagtagctcaacgcctgggaggatcgctggagcccaggagttcaccagcctgggcgatatagtgagacagtgagactctgtcccctccccaccaaaaaaagttttggcccagtctgggcaacatagtgagcccttgtctctacaaaaagtataaaactagctgagcatggtggtgcatacctgtggtcccagctacttggaaggctgaggcaggaggatcacttgagcccagaagtttgaggctgcagtgtgccatgattgtgccactgccctccaacatgggcagccagcagagccaagatcctgtatcaaaaaaaaaaggaaaaagtttcagcagttatataaagtttatttgctctttgatgttattacatatggttttataatctcttggggttttacttttaaaatactattcaaaactaaatggaatggaataataaaggagaaacaataagttactttatataaaacatatcacgcaaatgctctcattctgttggagctgttaaaaggtttggaaccaaaaatattaagaac

SEQ ID NO: 318890 - DNA, 464 bp, Homo sapiens
agcctgggtgacagagcgagactccatctcaaaaaaaaagaaaaagaaaagaggatcatctggtgtgagccactgcgcctggccttctactcttataagtagtattatagtgaacatcctgtaagtaaatctttgtgcatgtccacgtttatttccttaatttctaggagtgtaattgctatgtcaaaaataagcagttttttaaaagctttaagaatatttagaaatacggaatttaaatagattgctaaatgatgtgtgttgaagaaatttaactcaaagcctcctgatcataacatgctgtcttagttcattttctgctacaacagaatagcagggactgataatttgtaaatttgtaaataatagtagtttgtttggctcatggttctggagactgggcagtccaagagcatggcgccagcacctaagcaaggtccttggtgctgtgacatcccatggtg

SEQ ID NO: 318891 - DNA, 2749 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaaccacctgtgtagtctctctagtagttaaaacagctattttagtaaccccaagagtttcttctcatatccataaaattggattacagtatggcaatatctacagcttctattcattatgcaacgtttaacattgattggataaatgcttataggctgggccaggtggctcccacctgtagtcccagcactttgggaggcaaaggcgggaggatcacttgaggccaggactttgagaccagccagggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacttggcaaattctgaggtaagtgtatgatcttagggaactttgatacaaatgggaattcactcactggaatcgtggctcccaaaaagatgctttaattgtgtggtgcttttatagtttagctccaaaacaaactatagacattcactccagtaactcctagattaaatatacagtagctatgagggtctgccctcttatttcattaaatgctatttggttact

SEQ ID NO: 318892 - DNA, 1736 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgcc

SEQ ID NO: 318893 - DNA, 1704 bp, Homo sapiens
  misc_feature (1)..(1): n is a, c, g, or t
  misc_feature (16)..(16): n is a, c, g, or t
  misc_feature (23)..(23): n is a, c, g, or t
nattcggcatgagccncggattnaaattttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318894 - DNA, 1530 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagctgaaaaaaaaaaaaaaaaaaaaaaaaaaaaaacaaaaacaaaacaaaaaacacaaaagcacaaaaacacaaaaaaagacacgaaaacaaatacacaacaagctgcgacaacacacctctaccacgccactcccagcgcctcaccaccccgtcctcaccccccgccgccctaccccttcccgccaccctccaccaacagcgtgccccccactt

SEQ ID NO: 318895 - DNA, 1480 bp, Homo sapiens
gcacgaggattcttcagaaaattctattactagtttaaaagtaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318896 - DNA, 1985 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318897 - DNA, 2080 bp, Homo sapiens
gcagaatgacaagtgagcacacaagacataagaaaaggtgccaaactcatccttttatctggagtacactcctgccctgagcactcatgacctaagcacttcttaaaggtcccacttctcaacagtgttacaatggcaattaatttttttttatttaatttttttacttttatttttttgagacaggttcttaccctgtcatccaggctggagtgcagtggtgtgatctcggctcactgcaacccctgcctcctgggttcaagcgattctcctgcctcagccttccaagtagctgggattacaggcatgtgccaccatgcccggctaatttttataattttagtagagatggggtttcactgtgttggcccgactggtctcagactcctgacctcaagcaatcctgcctgcctcggcctcccaaagtgttcaggactggcgtgagccaccgtgcccagcctccagcaattacatttcaacatgagatttggagggaacattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318898 - DNA, 1978 bp, Homo sapiens
ttaaccaaagacagccatgtatgtggcagaggtaattgggttcttagtattcttttttgttttccttttatttttttgagacaggttcttaccctgtcatccaggctggagtgcagtggtgtgatctcggctcactgcaacccctgcctcctgggttcaagcgattctcctgcctcagccttccaagtagctgggattacaggcatgtgccaccatgcccggctaatttttataattttagtagagatggggtttcactgtgttggcccgactggtctcagactcctgacctcaagcaatcctgcctgcctcggcctcccaaagtgttcaggactggcgtgagccaccgtgcccagcctccagcaattacatttcaacatgagatttggagggaacattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318899 - DNA, 1959 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318900 - DNA, 1904 bp, Homo sapiens
agcctgggtgacagagcgagactccatctcaaaaaaaaagaaaaagaaaagaggatcatctggtgtgagccactgcgcctggccttctactcttataagtagtattatagtgaacatcctgtaagtaaatctttgtgcatgtccacgtttatttccttaatttctaggagtgtaattgctatgtcaaaaataagcagttttttaaaagctttaagaatatttagaaatacggaatttaaatagattgctaaatgatgtgtgttgaagaaatttaactcaaagcctccagcaattacatttcaacatgagatttggagggaacattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318901 - DNA, 2017 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318902 - DNA, 1572 bp, Homo sapiens
acaagccactgtacccagctgaaattataggtcttaaggcaattgagaactttatttcagaagcttaagttccttagcagcaggaaaccccatagtatttatcaaatcatttctaaaagtatttagacccaaaattatatgacatgttaatctctgaagtaatttgttgttttgtataacttttctgtaatatattccatatctgacccctgttggtataaagaacaactatgcaaatctgttttttcttttctttcctcctagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318903 - DNA, 1870 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318904 - DNA, 1193 bp, Homo sapiens
gcagaatgacaagtgagcacacaagacataagaaaaggtgccaaactcatccttttatctggagtacactcctgccctgagcactcatgacctaagcacttcttaaaggtcccacttctcaacagtgttacaatggcaattaatttttttttatttaatttttttacttttatttttttgagacaggttcttaccctgtcatccaggctggagtgcagtggtgtgatctcggctcactgcaacccctgcctcctgggttcaagcgattctcctgcctcagccttccaagtagctgggattacaggcatgtgccaccatgcccggctaatttttataattttagtagagatggggtttcactgtgttggcccgactggtctcagactcctgacctcaagcaatcctgcctgcctcggcctcccaaagtgttcaggactggcgtgagccaccgtgcccagcctccagcaattacatttcaacatgagatttggagggaacattcaaaccatagcaggtgcaaaataagagaccttagttttaagacaggttatcctgtgatacagaagaatttagttattacctaatatttaaaacttctaagccaagcattctgtttggtaaagatttctcttaactgttagatatggcagagtgtgtaactaattttagtattgtctttgcagtgtatgctgatggtagcatatgtttagatatccttcagaatcgatggagtccaacatatgatgtatcttctatcttaacatcaattcaggtaagtgtgtgttaggatgtattataatttgtcagtattctgtaggatatagtcagctccttagcacacaggtaaccaatggcagagcttggacaagaatccatgcttttcagctaacttttctctttcagtagtgcctacttgggatccagtctgcagtccctttcctgattgtgtaagttacatgttctcacaggtcaaacctaatttgtgtccatgaagcatagccaagggttgtggaaaagaaaaaatggcttggaaaaaccataggaacctaaagaaactgccaagtgtagataagcattgagtatgttaccccatccaagaaattctattttaaaaaaagaaaggaaaactaatgtaagtatatattttttttccagaagactgttagtagtatggtcaacatatgaatcaggaa

SEQ ID NO: 318905 - DNA, 1275 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactgcaagataaattagaaaaaaaaaatatttcaattagagttttggcccagcacagtagtagctcaacgcctgggaggatcgctggagcccaggagttcaccagcctgggcgatatagtgagacagtgagactctgtcccctccccaccaaaaaaagttttggcccagtctgggcaacatagtgagcccttgtctctacaaaaagtataaaactagctgagcatggtggtgcatacctgtggtcccagctacttggaaggctgaggcaggaggatcacttgagcccagaagtttgaggctgcagtgtgccatgattgtgccactgccctccaacatgggcagccagcagagccaagatcctgtatcaaaaaaaaaaggaaaaagtttcagcagttatataaagtttatttgctctttgatgttattacatatggttttataatctcttggggttttacttttaaaatactattcaaaactaaatggaatggaataataaaggagaaacaataagttactttatataaaacatatcacgcaaatgctctcattctgttggagctgttaaaaggtttggaaccaaaaatattaagaac

SEQ ID NO: 318906 - DNA, 1217 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttgggtgagttgaaaggtttaacaaataataggtgtgtgctgaatctttaagaaaagtaaacatataacaactgtctaggaaaagaaactgaggtggaatgagagatcttaaggactaaaactgcaagataaattagaaagatcgctggagcccaggagttcaccagcctgggcgatatagtgagacagtgagactctgtcccctccccaccaaaaaaagttttggcccagtctgggcaacatagtgagcccttgtctctacaaaaagtataaaactagctgagcatggtggtgcatacctgtggtcccagctacttggaaggctgaggcaggaggatcacttgagcccagaagtttgaggctgcagtgtgccatgattgtgccactgccctccaacatgggcagccagcagagccaagatcctgtatcaaaaaaaaaaggaaaaagtttcagcagttatataaagtttatttgctctttgatgttattacatatggttttataatctcttggggttttacttttaaaatactattcaaaactaaatggaatggaataataaaggagaaacaataagttactttatataaaacatatcacgcaaatgctctcattctgttggagctgttaaaaggtttggaaccaaaaatattaagaac

SEQ ID NO: 318907 - DNA, 2075 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318908 - DNA, 2022 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318909 - DNA, 1683 bp, Homo sapiens
acacaactcaggggcgagctgctaactcaggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318910 - DNA, 2049 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttgggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318911 - DNA, 2151 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtgtcttgctctgttgcccagactggagtgcaatggcacaatcttggctcaccgcaacctctgcctcccgggttcaatctctgctggatgaaccgaatcctaacagtccagccaatagccaggcagcacagctttatcaggaaaacaaacgagaatatgagaaaagagtttcggccattgttgaacaaagctggaatgattcataatagacaactggtctgttaatctttttcatcattgttgtgtataatttacctctcattagaaaggctaacaaattttaagtgccacaggttttaaggattctgcagaaaaaaaagaaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacatgtaaagctgttaaaatacataacttcagtgcaagagactttgtcacttatttccttatgtgtgtaggaggggttaataagtctctagctctccatctattgatagtttcatttacaatttcaaaagaacattcttatattttatcaaggaagtcttcaaatttgattctaaatagcgattataatctccaactttattttgaatgtacctctattagtttcaattgagtaattctagacataactggtttgactctgtccaactctgtatttaggccatttgttacagtttcttcatgcattacttactgttaaaactgtaccttttgcgatttcacagttggcacttctgccatgagcagagaactgatgcgacttgttttgctgcttggtagcactttaaaaaattttttgattaatgaagaaagtaaaaccataaacatttgccaaaaattcatgccccagtattagcaatgaattagttgcattggtttgagaaaggcacatattggagggaaatcttggtgtaacttaaatatttgaaaattacctttaatgcaatgcatatctgtttattctgggaaatgttttaatgccagggcctgctgagttgcttcttcttgtggagattttttttttaatctcctgagttgtataaaagttgtactgcatcttagtttactggataaatttaaaacacagtattgtagaaagctaatacaaaactatcctatgccttcaaatagtatagaaaatggaaaatatacaagtaaattctgttgaacca

SEQ ID NO: 318912 - DNA, 1194 bp, Homo sapiens
tctctggcccggatgcgtccctctttctccaccccgccgagcctaaactagtgacggggagggagacgggatagtgtttctgtttccgtggtctttgaatccacaacctctagtctgaacacagagaacacaaatttgtcgattacttcaggaagcccagggggaaccgcgccccgctgaagggctcggggaaggcgcgctcccgcgtcccgccccctcctcccccagcactcacactgtggtagcggcggagggcggagggatccggaggcggcggagggagacgtcattgcagggttgtttgtcagtctcggcggcggcggcggcggcggcggcggcggcggcgatccacagtgattcggccgccgcgccggggggtgggggggctgcgcgggacttttttttttttcagactgaccgcggggcagctgcggagcatgtcgaccccggcccggaggaggctcatgcgggatttcaagcggttacaagaggacccacctgtgggtgtcagtggcgcaccatctgaaaacaacatcatgcagtggaatgcagttatatttggaccagaagggacaccttttgaagatggtacttttaaactagtaatagaattttctgaagaatatccaaataaaccaccaactgttaggtttttatccaaaatgtttcatccaaatgtgtatgctgatggtagcatatgtttagatatccttcagaatcgatggagtccaacatatgatgtatcttctatcttaacatcaattcagtctctgctggatgaaccgaatcctaacagtccagccaatagccaggcagcacagctttatcaggaaaacaaacgagaatatgagaaaagagtttcggccattgttgaacaaagctggaatgattcataatagacaactgttatgtgaaagtttggcgctggaggatctacctctgagatggctcattcacatggctgtttgcagcagatctcagttcattactacatggatctctccacaagactgcttgagtgtcctcacatggcaggaggtcttccttcccgtctctattaaaaatacaaaaattaggcagggcgcagtggctcatgcctgtaatgccagcactttgggaggctgaggcgggtggatcatgaggtcaggagattgaaaccatcctggctaacacagtgaaaccctgtctctacta

SEQ ID NO: 318913 - DNA, 494 bp, Homo sapiens
ctaaaatagatataggaatataagaggtattttgttttgttttttacttgaaaaggaagaaaaacatggaagccttatggaaaagatccaggatagatggaaaaattgattgatacaggagagaggagggaaatttaggaaacaatccttgagtaggtaagcaaggatgggacttaccgcacaagtataaatgttggttacatctaggagcacatcgttcggaatgacaagaaagaccacagaatatatcaaaatatgttggtataaatactgataagtggaggatgtggttagtgggagcctttggaaagtatatctccttgttctttttatatttttcagtaaacttaaaaacagagtaatttgtgctgggattacaggcgtgagccaccgcgcccggcccttaattcttttgacagcatttttacttatgtgtcagttttctccctgtaatgtatttaagctattattttgataggttagtgtttaaacgt

SEQ ID NO: 318914 - DNA, 701 bp, Homo sapiens
caacatctgctatagataccatgaccagagaaaatacagtgctttggaatatgagtcctaaagtgaaagctacagggcatatgctctgacttcacactgactgacttcacatctgactccaggatgaatagcagcagaaatttattcatttgatattggttaagacttgtcctcaacaacatcttaaaggtcagctggtgtgatgtaaagtaaagctctgaaactcaaagttttacttcagatggcaaataacatttattcattaaattagctatattgataaagatgcttttagaatgttgtggaattatttttatttctagtcatctatccgaaggcattttgtaattgtgcttgtgtgtgtgtgtatatgtgtgtgtttgtgttacagtttaaaatcttactgtattacctacatcattgaaagaatcatcatgcagcctttctcaacaaaggcttatctagagaattataccctaatatcctaaagtatatttaatgaattaataaatatttaatgaattaacttactcattcctgggagaattgagaatagagtcattcaaatcattttctatggggttaaattctttggctgaacccgagttgagaaaggctgctagagaatgcattgaagaccaaagacttggttactgtttatgccaaacttcttaaagattaccaccaccataaaaacaaaa

SEQ ID NO: 318915 - DNA, 513 bp, Homo sapiens
caacatctgctatagataccatgaccagagaaaatacagtgctttggaatatgagtcctaaagtgaaagctacagggcatatgctctgacttcacactgactgacttcacatctgactccaggatgaatagcagcagaaatttattcatttgatattggttaagacttgtcctcaacaacatcttaaaggtcagctggtgtgatgtaaagtaaagctctgaaactcaaagttttacttcagatggcaaataacatttattcattaaattagctatattgataaagatgcttttagaatgttgtggaattatttttatttctagtcatctatccgaaggcattttgtaattgtgcttgtgtgtgtgtgtatatgtgtgtgtttgtgttacagtttaaaatcttactgtattacctacatcattgaaaggctgctagagaatgcattgaagaccaaagacttggttactgtttatgccaaacttcttaaagattaccaccaccataaaaacaaaa

SEQ ID NO: 318916 - DNA, 1100 bp, Homo sapiens
gcccagcacctgcagggccgaccagctccagtcccaggtccaatcctgagtggccaaaagccggaaacccggagttggaattggatcttgcacaagctggaccacccctcagaatctaggatagcacctggcacacatggtgagcactcacttcatggctgtcggataaacaatggagcaaggaaggtggagatggatgcttacacatggggaattgtatcaggaaggagtgtatgtgtgattaaaacctgttctacataaatagaaaagttgatcattcaacacatggacggctaagactatatgcagactatccattctcaggaggaaaagggaagcaatctacctgacttccccaaatggattccgtattttgatatgaattgttatcatgtgggaaatgcgatggcctccaggtatactacctctcagagatcagtgagcagaaaagctcacagatcaaattaaaatgcttgaatctcttagtttatttaaatcaatttaaagagacagtgaaaagcaagaggaaagagatgggataagtaaacgctgtcaagagacggtgcaaatctggtggaagatgcctgctacctaaagcctacctcatacaatgttcaggggccaccatcccccacctgccccaacctccacccctctctgtgatattgactttcctgtggatcgtggtgctgaagacgacaggtttgagcaaggagactcaaagaggcaaggtgccccacgccaatgacacaaacttgctctgtccgagatgcaggtacaagcaagcctggcaaagagctgagctttgcctgttggcctgtggagcaaccatgggttttactgtgtttcttggacagaggacacttggggacagaagtgaatagcatgactatttcatgcttatgtgtattttatgcactgtatttagtgcctcttggacatttaatgtatcaaatatttcatgctcaggtgtctcatgtatacttggtagctaggaatgttaggtatcctggactttctattcctttctgtgtctaacacatgttctacttactacttaacacatctaataaaatctgcctatgttttaaaaactaaga

SEQ ID NO: 318917 - DNA, 685 bp, Homo sapiens
gctcctcttctgtgtttcctgcaccaccattcgctcagttgctctacactaaaatttgctgtcatcgttgacttctccctctccttcatcccctacaagtatcaacatagacaactccgatcaatataatcatcagtgaataaagcaaattgcagcgcatattcttaaagacaaactttccacttgcagcagcacctaccttccagatagctaaattgaagcccgtgtttatcatagctgcttctaaccagccagagctgataataactaagaacttgcaggaattgcagtatgccagaccttcaatttaattgaagactttcctgaacaattaatgagacttgtcttaaccagcagggaatggctttagggactcattcttccctatgcaggtgcaagcctcaaaccttaattaggatcatccaccatgatcctcgagcccttccccaccttatacttgaagaggctgaacctcagagaattaaattacctacagtcctggtcactggtagagctattatttaaagtaaggtctaatgtcaaagcctgcgtccttaattctaccatatgctgcttcttgcagtgtcgttcctcaaccagaacacatagctcttctgtgtaggtaaagtccatcaaaacatgtcataaaataaattaaagaaattggtttctgctctatttcaat

SEQ ID NO: 318918 - DNA, 852 bp, Homo sapiens
ggcggggagtgaggcggggcatcgcggctagcgccgttggcggggaaccgggcggggaatctctgtgcttcctcagtccccaggcccagcacctgcagggccgaccagctccagtcccaggtccaatcctgagtggccaaaagccggaaacccggagttggaattggatcttgcacaagctggaccacgtaagctgggccaggccagaggtggaggccaccgctgcgggaggagggcatctgatgattttgaaggaccccattaatagagggtataaaccaggtgcgggccatcagggaggattgtcactctggcccgatcttgtttgtttacaccaggaagggcctgccttccacctgcaagaaaatatggcagctgcagaataatgtggcgcaatgccaaatatccgtttgttttagggagtgaggctacttgagaagcatcttaaatggggagagagagcaagttaaatctgatttccacgcagctctgtggattccgaatgtccacagtatgatgttatctccattcccacttccgagccgctcctcttctgtgtttcctgcaccaccattcgctcagttgctctacactaaaatttgctgtcatcgttgacttctccctctccttcatcccctacaagtatcaacatagacaactccgatcaatataatcatcagtgaataaagcaaattgcagcgcatattcttaaagacaaactttccacttgcagcagcacctaccttccagatagctaaattgaagcccgtgtttatcatagctgcttctaaccagccagagctgataataactaagaacttgcaggaattgcagtatgccagaccttcaatt

SEQ ID NO: 318919 - DNA, 3289 bp, Homo sapiens
ggtgtgctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagttcaccatttcaggtcactgctggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaaagtgtttaaaagcaaattactgactttcaaaaaagtttttaaaacctgatttgaaagctaacaattttggatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttccaaggccaagccgtggaatggtagcaatgggatataatacccttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatctctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 318920 - DNA, 3928 bp, Homo sapiens
ggtgtgctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaaagtgtttaaaagcaaattactgactttcaaaaaagtttttaaaacctgatttgaaagctaacaattttggatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttccaaggccaagccgtggaatggtagcaatgggatataatacccttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatctctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 318921 - DNA, 4453 bp, Homo sapiens
ggtgtgctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggagtaagtaatctaatagaaaaatctcttatttatcttattgctacaacgtttagtgtcagtgatacactcggacttgtgtaaaatttggggaaagacacacttcctgttcaaaatccaaactcagagtaacctcacgtagcttgtttgatcctgtttatttttgactggacacctagtttcatgaactacagacaggaagggttggagacagggtgatggaaagtttttgatcaactttcacttgatgcctcttgacactgattagagtagtaagggtaagtaaggtagcttcgtgatgacaaattttaatttggtgcgtagttgtccccgatcttctatgatgataggtactttagaagacttcaggtgtttacccaagtcttggaagctaacacttgaaaattgattctagttttgttaacggttctattttcagtcacagatacatttccatggtaaaaagctgaagctgggccctgcaatcaggaaacaaaagttatgtgagtaggaaaagaaatggttcttttctgacccgtgtagcttttcaaataactaaaaataggcttttttcttcttgctttttaaaaaggtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaaagtgtttaaaagcaaattactgactttcaaaaaagtttttaaaacctgatttgaaagctaacaattttggatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttccaaggccaagccgtggaatggtagcaatgggatataatacccttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatctctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttca

SEQ ID NO: 318922 - DNA, 289 bp, Homo sapiens
cattcaattaatttgtcacatgtgttgaaagccttttgtgggctcaggtgctggagtcggctccccagaaggcaactgggagtgacacagagctcactccacttttgtgaaatggaaggtgtagtggccacggaaaacaaatcgttacaaactgctccaagaggtctgcgtagcactcagcggttcagattgtcatagggacctctttagatggagccatcagagaaggccacattgaggaaggagatttaaaggcaagattggaaagttgagaagaagccacagagac

SEQ ID NO: 318923 - DNA, 2076 bp, Homo sapiens
agcccagagacacattggggctgacctgccgctgctgtcagtgggaggccagtggtgctggccaagaagtgtcatggctggtgtcgtgcacgtttccctggctgctcactgcggggcctgtccgtggggccggggcagactccgcaaaggacgcgcagcctgcaagtccgcggcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaa

SEQ ID NO: 318924 - DNA, 2055 bp, Homo sapiens
cagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagtctgggagaccgaaaccattggagagtctgattttggtgacagtaactccttagatctctcagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaa

SEQ ID NO: 318925 - DNA, 1992 bp, Homo sapiens
cagccggccacacaggcgcggagacccggctcggcgcgcgctcctcggcgcacacgctccccatccccgcgccgcgcgggccgcggacttgcaggctgcgcgtcctttgcggagtctgccccggccccacggacaggccccgcagtgagcagcccagagacacattggggctgacctgccgctgctgtcagtgggaggccagtggtgctggccaagaagtgtcatggctggtgtcgtgcacgtttccctggctgctctcctcctgctgcctatggcccctgccatgcattctgactgcatcttcaagaaggagcaagccatgtgcctggagaagatccagagggccaatgagctgatgggcttcaatgattcctctccaggctgtcctgggatgtgggacaacatcacgtgttggaagcccgcccatgtgggtgagatggtcctggtcagctgccctgagctcttccgaatcttcaacccagaccaagacatgggagtggtgagccggaactgcacggaggatggctggtcggaacccttccctcattactttgatgcctgtgggtttgatgaatatgaatctgagactggggaccaggattattactacctgtcagtgaaggccctctacacggttggctacagcacatccctcgtcaccctcaccactgccatggtcatcctttgtcgcttccggaagctgcactgcacacgcaacttcatccacatgaacctgtttgtgtcgttcatgctgagggcgatctccgtcttcatcaaagactggattctgtatgcggagcaggacagcaaccactgcttcatctccactgtggaatgtaaggccgtcatggttttcttccactactgtgttgtgtccaactacttctggctgttcatcgagggcctgtacctcttcactctgctggtggagaccttcttccctgaaaggagatacttctactggtacaccatcattggctgggggaccccaactgtgtgtgtgacagtgtgggctacgctgagactctactttgatgacacaggctgctgggatatgaatgacagcacagctctgtggtgggtgatcaaaggccctgtggttggctctatcatggttaactttgtgctttttattggcattatcgtcatccttgtgcagaaacttcagtctccagacatgggaggcaatgagtccagcatctacttgcgactggcccggtccaccctgctgctcatcccactattcggaatccactacacagtatttgccttctccccagagaatgtcagcaaaagggaaagactcgtgtttgagctggggctgggctccttccagggctttgtggtggctgttctctactgttttctgaatggtgaggtacaagcggagatcaagcgaaaatggcgaagctggaaggtgaaccgttacttcgctgtggacttcaagcaccgacacccgtctctggccagcagtggggtgaatgggggcacccagctctccatcctgagcaagagcagctcccaaatccgcatgtctggcctccctgctgacaatctggccacctgagccatgctcccctcctcctcctctcctccatccacaggctgggaccgcaggcaggtgccagcccacgcatgtttgcgcctcttccctccccttgggcaggccctgggctggaagcttggctcctgaggggggagaaggaggcagggcacagactggaattgtcccctccttgttttggtactggtcccacccactgtggtcccctgggccctgaccccagacatgtaaatactcctcaaatttggaaaagttgtcccatcccttccccctttgccccagtgtccctgctcacttccagtcaggtctcagctccaccccactgtttcttggtcagcctcagtgatggcctgaccccagctgtgaggccttgtgagctaaggctgaagagaccttgcctgtgggagctggggtggtacctgccccaa

SEQ ID NO: 318926 - DNA, 1936 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318927 - DNA, 767 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccaccctcatccgcttatccaatgcc

SEQ ID NO: 318928 - DNA, 580 bp, Homo sapiens
  misc_feature (27)..(27): n is a, c, g, or t
  misc_feature (31)..(31): n is a, c, g, or t
  misc_feature (51)..(51): n is a, c, g, or t
  misc_feature (86)..(86): n is a, c, g, or t
  misc_feature (101)..(101): n is a, c, g, or t
  misc_feature (104)..(104): n is a, c, g, or t
  misc_feature (127)..(127): n is a, c, g, or t
  misc_feature (137)..(137): n is a, c, g, or t
  misc_feature (143)..(143): n is a, c, g, or t
  misc_feature (169)..(169): n is a, c, g, or t
  misc_feature (198)..(198): n is a, c, g, or t
  misc_feature (223)..(223): n is a, c, g, or t
  misc_feature (259)..(259): n is a, c, g, or t
ggggggccaaggccgggccctttgctngttnttgggcaagtgtcccttttnggaaaaaggaaacttgccccccagggcttttaaantgccaagcttggccnaanccccttggttaaaggccctgggncccttcctcngaaggncccttcttttcttgaacccttccaanggggttccaccaccccccccctccaaaangaatcccttcttccaccccaatggntaagtttggcttggttcggtgggttcctggtcctgntcccggtgccacccgaatggcacaacacccggcaccccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318929 - DNA, 357 bp, Homo sapiens
ccccccccccccaaaattttcacaccagattggtgtgtgtttgttgtccgtgcacaaaaaaaaaaccccccccccccccccccccccctgtttttaaattgaagaaggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318930 - DNA, 292 bp, Homo sapiens
  misc_feature (38)..(38): n is a, c, g, or t
ggacgcgtgggtcggacgcgtgggtcgacccacgcgtncggggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318931 - DNA, 616 bp, Homo sapiens
tgagacggagtttcgctcttgttacccaggctggagtgtagtggcacgatctctgcttactgcagcctctgcctcccgggttcacgccattctcctgcctcagcctcccgagtagctggtactataggcgcccgccacctcgcacagctgatttattgtctttttagtagagacattttcaccatgttagccaggatggtctcgatctcctgacctcgtgatccacctgcctcagcttcccaaagtgctgggattacaggagtgagccaccatgcccggccctgtttctgtgattatcttacattgtcattgtccccccaggcctgtctttcactgtggcatgcattgtctagggtagatgcttgttagatattttatgacttgctgtctttttcaacagacaaattgatggccaggagatcactgccaccgccgtgctggccccctggcctaggccaccccccaggagattcagccctcccaggagaatgttgccaccaccgcctatgtggcgcaggtctcccccacggatgaggagaagaaggtaaacaatttgtagtttcagtggactgatcaggccacaaacctcatgtgaccgcagtgactttcagaccct

SEQ ID NO: 318932 - DNA, 229 bp, Homo sapiens
gcggccgcctactactactactactgctcgaattcaagcttctaacgatgtacggggacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318933 - DNA, 2196 bp, Homo sapiens
ggaggacgagcctcggtcatcgcgctgccctcccaggttcaacagcctacccatgtgcccgctccagtaagcgtgcaaccagcccggtcagtcccagggactttaccggctaggagacaccttgaacgtccccagcgcgactcccacaaactgccttgactctttaacgcttcctcgctggcgcccattgggccaggcgtttacgtcatcgctgcgcgccgggcggcggcgacttcccgctccttgactctgacgtcagagcggcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318934 - DNA, 1919 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318935 - DNA, 3629 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggtgaacagagaacctcaacttttgctttctagcactcgaccgcacccagcaaggcgtccgcttactcagtggttcttagtgtttggagtgcttaagaataactggtggtgtttgatttcaccaagtacattcgggcagatcttagttcttgggggggtggggctggaatctgcgggtgtgacctccactctaggtctgtgctgtccagccaagtagccattggccacatgtggctgctaagcatgtgaaatacagctaatcaagactgaaatattaaaacacacaccagttttagaagactaggaaaaaagcaaacttttattagatgtttatgttgattatatgttggaaagataatattttggatgtgtcaaacgttaaaaattaatttcacccatttttgtgacgtggctactaaggaatttcaggtgatgcttgtggctcctcacacggtttctattggacagtgctgctgcaggtgattcgaaggcgggtgggtgcaggaacccagctgagagttcagaaattagtgtaactttggagacaagtgtctgtgggggaaggagcctccggacgtggagatacaactcttgctcctaacatttatcgagtctttaattaatgccctgggtaactataaggttggaactgtaattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttggctctcatttgactgttcaaagccaggtgcttttctttcttgggtcagaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318936 - DNA, 2165 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318937 - DNA, 1932 bp, Homo sapiens
  misc_feature (29)..(29): n is a, c, g, or t
  misc_feature (32)..(32): n is a, c, g, or t
tcccacacatacgcgcttaggacgggccnggngttaggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318938 - DNA, 2229 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatgtaagttggggcggaatccgactgcatccgtgtttcgggggctgcccggcaggcccggcaggacgcctcgtgaagccggtccactcctcagccccgcagtgcggcggtggcctggcagcgcggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318939 - DNA, 1880 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318940 - DNA, 2041 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatgtaagttggggcggaatccgactgcatccgtgtttcgggggctgcccggcaggcccggcaggacgcctcgtgaagccggtccactcctcagccccgcagtgcggcggtggcctggcagcgcgggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318941 - DNA, 1748 bp, Homo sapiens
ggcacgagggagagagaggaggaggaaagcaggaggaggtggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318942 - DNA, 2702 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaaatctgagatgaatattaattttattctcattttatagatgaggaaatgggagttttaaagacattcaataactttggccaaggtcattcagctattaaattttaagaccataaaccaattggattcctggaggaattc

SEQ ID NO: 318943 - DNA, 2141 bp, Homo sapiens
agtaatttgtaaaattagctgagcgtggtggcatgcatctgtagtcccagctacttgggagggctgaggcaagaggatggcttgagcccaggagtttgaggaaaataaacaaaactagccgggtgtggtggtacacgcctgtactcccagctactcgggaggctgagtcaggaggatggcttgattccagggggttgaagctgcagtgtgcggagatcatgccactgcactccagcttgggtggcagaccctgtctcaaaagaaaaaatcaacctagcctgggtcagcatcagccagcagctgccttcccagcctgagttggcagttgtgacttttgccagagtcctttgcctcccagcaggaaaggcttctgtatgggtagaaggcagcccatcacctctgtcctgtcccacacacaatgtgacacctagggctctgacttgctgggggattggggggtgatgttttccccactgctgaaagcagtgaggcctggaggcacccgaacagcaggtttctcctggggggagcacaacagaattggaggaggcatctgtactgtgagacttggtgtgtggtggttgtgacccctcatcttgccctcaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318944 - DNA, 1789 bp, Homo sapiens
aagagcggtagcaggacctcggtgggtgaggaaagcaggaggatgtggtgagcgtgggcataatggttccttaagcatactcacatgcgtcaataggactcagctgcatagtgataatgtccaaggtatcgctcgacaagatggagggggcagcgataggtaggatcgagatgcacgagagtgatcgtcgcgtagcgggacataaactcggatcagatggcgcagggagttccagtgatagcaatattaccatggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318945 - DNA, 1708 bp, Homo sapiens
  misc_feature (69)..(69): n is a, c, g, or t
aaggatcgctcaaacagataaagggggtcgacacaatgggagctctgaagctgatgaacgcgatcggangagtcgtggcgatccaatagaacctcagatagagagggcgtatggtgcattcacatgatggataagccgacgccaggtggcagagtcgtacgcggtccatggcatacgaacatttccagactgcgaggtctctcgaagcgatcatgcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318946 - DNA, 1449 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttggggtgccgtacctggggccattcctcccaattcggggtggcgccgctttgggggcgtctgagagcg

SEQ ID NO: 318947 - DNA, 1331 bp, Homo sapiens
ttgggagactcacccggaatgtgcactttggtgggcttaggagatgggctccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318948 - DNA, 1245 bp, Homo sapiens
  misc_feature (38)..(38): n is a, c, g, or t
ggacgcgtgggtcggacgcgtgggtcgacccacgcgtncggattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318949 - DNA, 1485 bp, Homo sapiens
tgagacggagtttcgctcttgttacccaggctggagtgtagtggcacgatctctgcttactgcagcctctgcctcccgggttcacgccattctcctgcctcagcctcccgagtagctggtactataggcgcccgccacctcgcacagctgatttattgtctttttagtagagacattttcaccatgttagccaggatggtctcgatctcctgacctcgtgatccacctgcctcagcttcccaaagtgctgggattacaggagtgagccaccatgcccggccctgtttctgtgattatcttacattgtcattgtccccccaggcctgtctttcactgtggcatgcattgtctagggtagatgcttgttagatattttatgacttgctgtctttttcaacagacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318950 - DNA, 1161 bp, Homo sapiens
  misc_feature (38)..(38): n is a, c, g, or t
ggacgcgtgggtcggacgcgtgggtcgacccacgcgtncggatgaagccgagaaggcgctgaagcacatggatgggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318951 - DNA, 1154 bp, Homo sapiens
  misc_feature (1051)..(1051): n is a, c, g, or t
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgcnagaccgtcagttcaattctcccgtaaggccatgagtttggccctgttattttccaccgtcagttggctttctgccagaacctggaggacctttttggggtggg

SEQ ID NO: 318952 - DNA, 1124 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgcaaaccacgagttcacaggatatagctcctagtcgccgactctatcacgattacaggtaatatcatgttccctgc

SEQ ID NO: 318953 - DNA, 1086 bp, Homo sapiens
tgagatcgtgccactgcactctggcctggagacagagtgatattccatctcaaaaagtaaaactatggggaattgcccagaaagaagctagcttgcccctacagcctgagctactctgatgtggtttctcctcttcccgcaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318954 - DNA, 1095 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggagacaaactgatggcaggagatcactggcacgacgtgaaggcccgggctaggcaccccaggagatcagcgtcacagggaaatgtgaacaacgcaagtgggaggtctccccacgataagaaaagtcggaccgaggcagtcccggcgcgaaacacggcccgcgcgacgacagagaggcaaacactcaaaagagagcccgcgataccccacagttgttgcagaacggagaccgcggagaggaacacaagc

SEQ ID NO: 318955 - DNA, 921 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggagggtgggtgaccctgccacataaccctgacctctcagagacccgccgccgcgaggggctttcaaactgattt

SEQ ID NO: 318956 - DNA, 527 bp, Homo sapiens
aatgagggctaaggggaaagaagctccctatgaatcatgataagcttgatgagaagatgaaggtggagctggcctgcaatcaagcctggaattccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318957 - DNA, 904 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggagggtgggtgaccctgccacataaccctgacctctcagagacccgccgccgcgaggggctttcaaactgattt

SEQ ID NO: 318958 - DNA, 565 bp, Homo sapiens
gctgtgttcatgtgtgctgtgcatgcgtgtgtgctgtgtgtgcatgtgtgtgctgtgtgctgtgttcatgtgtgtgctgtgtgtgcgtgtgctgtgtgcatgtgtgtgctgtgtttgtgtgtgtgctgtgtgtgctgtgttcgtgtgtgctgtgttcgcgtgtgtgtgctgtgtgtgcatgtgtgtgctgtgtctttgtgtgtgtgctgtgtgctagtgtgtgtgctgtgtgtgcatgtgtgcgcgtgtgtgtgctgtgcgtttgtgtgtgtgctgtgtgctcatctgtgtgctgtagtgtgctgtagcgtttgggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318959 - DNA, 2602 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggtgaacagagaacctcaacttttgctttctagcactcgaccgcacccagcaaggcgtccgcttactcagtggttcttagtgtttggagtgcttaagaataactggtggtgtttgatttcaccaagtacattcgggcagatcttagttcttgggggggtggggctggaatctgcgggtgtgacctccactctaggtctgtgctgtccagccaagtagccattggccacatgtggctgctaagcatgtgaaatacagctaatcaagactgaaatattaaaacacacaccagttttagaagactaggaaaaaagcaaacttttattagatgtttatgttgattatatgttggaaagataatattttggatgtgtcaaacgttaaaaattaatttcacccatttttgtgacgtggctactaaggaatttcaggtgatgcttgtggctcctcacacggtttctattggacagtgctgctgcaggtgattcgaaggcgggtgggtgcaggaacccagctgagagttcagaaattagtgtaactttggagacaagtgtctgtgggggaaggagcctccggacgtggagatacaactcttgctcctaacatttatcgagtctttaattaatgccctgggtaactataaggttggaactgtaattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttggctctcatttgactgttcaaagccaggtgcttttctttcttgggtcagaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagaggtaatccttctgtaagatttttctagtgctacttgggggtgcttactgctagggacccgcagaaaggggaaagttgagaatgttctgcattctacagtgagtgttctgagccacagaccactttgctctgtggtcacctcgggtctctgtggccctgctgatgctgatcccccgttttgggttgtgctgtttgggtttggtcagaggagcacgcaatctcacactcttcctcaccatccagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtggggcgggctggcctggagcctggagaggacctgtgccacagctacacccccactccccacagatggctcggttttcttgattatttacaaagaaaacacatcctctgattgttagtagagaccctaatttatggcagactggctaggtgcagtggtggctcatgcctataatcccagcactttgggaggccgaggcaggaggattgcttggggcctggagttcaagaccagcatgggcaacaaaacaagagctcgtctctac

SEQ ID NO: 318960 - DNA, 631 bp, Homo sapiens
  misc_feature (62)..(62): n is a, c, g, or t
atcccggtcactgcacactaatcagtggtggaagaacggtctcagaactgtttgtttcaatnggccatttaagtttagtagtaaaagactggttaatgataacaatgcatcgtaaaaccttcagaaggaaaggagaatgttttgtggaccactttggttttcttttttgcgtgtagaaattgaacactgggtttgccattcatcccctaggcatggtaaatcttgtgttgttccctgctgtcctctgtattacgtgaccggcaaataaatctcatagcagttaatataaaacatctttggaggatgggagagaacaggagggaagatgggaaacaaaatagagaattcttaagattttgtttaaaccaaatggtttccatgttgaatgcaaaatgtggggacgtcaaaaatatgaatgtgtagaaattgaacgtggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318961 - DNA, 1009 bp, Homo sapiens
  misc_feature (29)..(29): n is a, c, g, or t
  misc_feature (32)..(32): n is a, c, g, or t
tcccacacatacgcgcttaggacgggccnggngttaggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggagccaattggtggccagagaacaaatggcagcgcgcgggcggccactgggcaaagcaccccaaggagaatagccctccaggaaagtggcaccaccgctatgagcggagcccagggaagagaagggcaccgggagagcccggcaggaacaagaagccgcgcacaca

SEQ ID NO: 318962 - DNA, 837 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtggggcgggctggcctggagcctggagaggacctgtgccacagctacacccccactccccacagatggctcggttttcttgattatttacaaagaaaacacatcctctgattgttagtagagaccctaatttatggcagactggctaggtgcagtggtggctcatgcctataatcccagcactttgggaggccgaggcaggaggattgcttggggcctggagttcaagaccagcatgggcaacaaaacaagagctcgtctctac

SEQ ID NO: 318963 - DNA, 2077 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318964 - DNA, 2184 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318965 - DNA, 2530 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318966 - DNA, 2266 bp, Homo sapiens
  misc_feature (2118)..(2118): n is a, c, g, or t
  misc_feature (2159)..(2159): n is a, c, g, or t
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaaaaaaaaaaaaaaaaaaaaaaaaagggggggggggcaaaaagtttccctgggggggccaaagttaaaggggtaccccagttttcgggtacaagggggcccctagggggagccgtataaaagggccaggcagtggccggccgttaaccaagcgtcgtgggggaacctttgtacgtgggactctngtggaagggacctactctcgtgggggaccttcttgggcaanctacccaaaggagataaagctccagggaaatttaacatttcaggggtctatgtgtaaccaagcgatattcgtgcgctagaaattgcttacgggttgattagacatta

SEQ ID NO: 318967 - DNA, 1915 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccaggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318968 - DNA, 3872 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggtgaacagagaacctcaacttttgctttctagcactcgaccgcacccagcaaggcgtccgcttactcagtggttcttagtgtttggagtgcttaagaataactggtggtgtttgatttcaccaagtacattcgggcagatcttagttcttgggggggtggggctggaatctgcgggtgtgacctccactctaggtctgtgctgtccagccaagtagccattggccacatgtggctgctaagcatgtgaaatacagctaatcaagactgaaatattaaaacacacaccagttttagaagactaggaaaaaagcaaacttttattagatgtttatgttgattatatgttggaaagataatattttggatgtgtcaaacgttaaaaattaatttcacccatttttgtgacgtggctactaaggaatttcaggtgatgcttgtggctcctcacacggtttctattggacagtgctgctgcaggtgattcgaaggcgggtgggtgcaggaacccagctgagagttcagaaattagtgtaactttggagacaagtgtctgtgggggaaggagcctccggacgtggagatacaactcttgctcctaacatttatcgagtctttaattaatgccctgggtaactataaggttggaactgtaattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttggctctcatttgactgttcaaagccaggtgcttttctttcttgggtcagaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagaggtaatccttctgtaagatttttctagtgctacttgggggtgcttactgctagggacccgcagaaaggggaaagttgagaatgttctgcattctacagtgagtgttctgagccacagaccactttgctctgtggtcacctcgggtctctgtggccctgctgatgctgatcccccgttttgggttgtgctgtttgggtttggtcagaggagcacgcaatctcacactcttcctcaccatccagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318969 - DNA, 1889 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318970 - DNA, 2189 bp, Homo sapiens
gactgcaaagtagacttgttgccttgccaattcgttcactctttaaacccttttatcttgttattaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagaggtaatccttctgtaagatttttctagtgctacttgggggtgcttactgctagggacccgcagaaaggggaaagttgagaatgttctgcattctacagtgagtgttctgagccacagaccactttgctctgtggtcacctcgggtctctgtggccctgctgatgctgatcccccgttttgggttgtgctgtttgggtttggtcagaggagcacgcaatctcacactcttcctcaccatccagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318971 - DNA, 1951 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318972 - DNA, 3536 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggtgaacagagaacctcaacttttgctttctagcactcgaccgcacccagcaaggcgtccgcttactcagtggttcttagtgtttggagtgcttaagaataactggtggtgtttgatttcaccaagtacattcgggcagatcttagttcttgggggggtggggctggaatctgcgggtgtgacctccactctaggtctgtgctgtccagccaagtagccattggccacatgtggctgctaagcatgtgaaatacagctaatcaagactgaaatattaaaacacacaccagttttagaagactaggaaaaaagcaaacttttattagatgtttatgttgattatatgttggaaagataatattttggatgtgtcaaacgttaaaaattaatttcacccatttttgtgacgtggctactaaggaatttcaggtgatgcttgtggctcctcacacggtttctattggacagtgctgctgcaggtgattcgaaggcgggtgggtgcaggaacccagctgagagttcagaaattagtgtaactttggagacaagtgtctgtgggggaaggagcctccggacgtggagatacaactcttgctcctaacatttatcgagtctttaattaatgccctgggtaactataaggttggaactgtaattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttggctctcatttgactgttcaaagccaggtgcttttctttcttgggtcagaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318973 - DNA, 1855 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318974 - DNA, 1174 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagtcgaacggactgggtgatcctcagaacgacta

SEQ ID NO: 318975 - DNA, 1777 bp, Homo sapiens
cgacaagcagagggcaaggtagaggatgatgacccgggaacagggctgaagagaaagtctgcgctgggagctgcaggctgggcccatcaggagcctgggggctcggctctggaggggctgaagagaaagtctgcgctgggagctgcaggctgggcccatcaggagcctgggggctcgccggcctcggcggctgaggaaagcaggaggaggtggcggcggcgggaagatggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggtcccgctccccgaggcgcaggtcccccgtgcgccggagatcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaa

SEQ ID NO: 318976 - DNA, 1163 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgccgccgccacaggagccgctccagctccaactcctcccgataaacaggccactgaagctctcagtccgttcgactgagcaggttggagggctttagatctcggtggagcacgta

SEQ ID NO: 318977 - DNA, 1414 bp, Homo sapiens
  misc_feature (1311)..(1311): n is a, c, g, or t
ggaggacgagcctcggtcatcgcgctgccctcccaggttcaacagcctacccatgtgcccgctccagtaagcgtgcaaccagcccggtcagtcccagggactttaccggctaggagacaccttgaacgtccccagcgcgactcccacaaactgccttgactctttaacgcttcctcgctggcgcccattgggccaggcgtttacgtcatcgctgcgcgccgggcggcggcgacttcccgctccttgactctgacgtcagagcggcgccggcctcggcggctgaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggaggacaaattgatggccaggagatcactgccaccgccgtgctggccccctggcctaggccaccccccaggagattcagccctcccaggagaatgttgccaccaccgcctatgtggcgcaggtctcccccacggatgaggagaaggtcccgctccccgaggcgcaggtcccccgtgcgccggagatcacggtccccgggccgcnagaccgtcagttcaattctcccgtaaggccatgagtttggccctgttattttccaccgtcagttggctttctgccagaacctggaggacctttttggggtggg

SEQ ID NO: 318978 - DNA, 1013 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggagccaattggtggccagagaacaaatggcagcgcgcgggcggccactgggcaaagcaccccaaggagaatagccctccaggaaagtggcaccaccgctatgagcggagcccagggaagagaagggcaccgggagagcccggcaggaacaagaagccgcgcacaca

SEQ ID NO: 318979 - DNA, 923 bp, Homo sapiens
ggcacgagggagagagaggaggaggaaagcaggaggaggtggcggcggcgggaagatgctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtctcggtccagctcgacttccagctcaggctccagcaccagcactggctcaagcagtggctccagctcttcctcagcatccagccgctcaggaagctccagcacctcccgcagctccagctctagcagctcttctggctctccaagtccttctcggcgcagacacgacaacaggaggcgctcccgctccaaatccaaaccacctaaaagagatgaaaaggagaggaaaaggcggagcccatctcctaagcccaccaaagtgcacattgggagactcacccggaatgtgacaaaggatcacatcatggagatattttccacctatgggaaaattaaaatgattgacatgcccgtggaaaggatgcatccccatctgtccaaaggctatgcgtacgtagagtttgagaatccagatgaagccgagaaggcgctgaagcacatggatggagtatttaggcctcattaatgagcaatagatatgattacgcattcactgccggtcgtttttcctaaggagtcagc

SEQ ID NO: 318980 - DNA, 2357 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggtgaacagagaacctcaacttttgctttctagcactcgaccgcacccagcaaggcgtccgcttactcagtggttcttagtgtttggagtgcttaagaataactggtggtgtttgatttcaccaagtacattcgggcagatcttagttcttgggggggtggggctggaatctgcgggtgtgacctccactctaggtctgtgctgtccagccaagtagccattggccacatgtggctgctaagcatgtgaaatacagctaatcaagactgaaatattaaaacacacaccagttttagaagactaggaaaaaagcaaacttttattagatgtttatgttgattatatgttggaaagataatattttggatgtgtcaaacgttaaaaattaatttcacccatttttgtgacgtggctactaaggaatttcaggtgatgcttgtggctcctcacacggtttctattggacagtgctgctgcaggtgattcgaaggcgggtgggtgcaggaacccagctgagagttcagaaattagtgtaactttggagacaagtgtctgtgggggaaggagcctccggacgtggagatacaactcttgctcctaacatttatcgagtctttaattaatgccctgggtaactataaggttggaactgtaattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttggctctcatttgactgttcaaagccaggtgcttttctttcttgggtcagaacgtattttcagcagcattttgaagcacccctggcgtgcactgcacagggaaaccaggaccacattggtgtgctgtgtcctccttaccaactggctcttggagaaggtgagacagaagtagctgagactccattcctgagatcttcacttaacaactcctgcagcttgtgcagagccttactagaaatactgaaggcagaagtccctggaaaatagggcccataactaattagtaatttgtttttgagtaatttgttaccgttatttgagcacattctgcagtccaggcattttgctaaactcttacatggcaggcagtctctcacgcaatttcaatgcctactttttttctccatcttatttttgaaaaatgttaaaaaaaacacaggaaggtcgagttatacagttaatactcacataaagaccacttaagggccgggtctggtggctcacgcctgtaatcccagcactttgggaggccgaggttggcggatcacgaggtcaggagttggagaccagcctggtcaatatggtgaaaccctgtctctactgaaaatacaaaaattagctaggcctggtggcgtgcatctgtagtcccagctactcgggaggctgacgcagaagaaatgcttgaacccgggaggcggaggttgcagtgagccaagatcgcaccactgcactccagcctgggtgacagagcaagactctgtctc

SEQ ID NO: 318981 - DNA, 2359 bp, Homo sapiens
gtggtaggggccgctgcggacggaagggcgcctgtgcttcgtccgctcggcggtggcccagccaggcccgcgggactcagaccagcggggagcgcggcctccgcccttggggccctcccgccgggccggagacccaagcccccaacgccaggccctgccctggaagcgctcgcggcccggcgcctggacgggggagttgtgagtgaacgcggacgggtagcggcgaggtcggcgtgtcgggccggtgtcggcgggcgcggagtttctttgtgggatgcggtggaaggtcggccgatccccccttcggagtcattaattcaaacgtgtacccgcgaacgtttcccggactcccgtgtgcaattatcggcgctaggccgtggggatacggcccactatggaccgagcacggtggccgagctcagtttgatgggttaccccagaggggcggatacgggaaggttaagtttgttggaggagaaacgtggagtaggctttttgtcttgattccgcatgaactgtgcctgaaatgtacttttaaatggggaaggtgctctgaagatttgtgccgaaacgccctctcctcgagatttaactaattgttctctcctctctctggctgttggacgcgcacctttccggaggatgggggaggtaaccgaggtcctgagccggtacctgaacttgggtgaacagagaacctcaacttttgctttctagcactcgaccgcacccagcaaggcgtccgcttactcagtggttcttagtgtttggagtgcttaagaataactggtggtgtttgatttcaccaagtacattcgggcagatcttagttcttgggggggtggggctggaatctgcgggtgtgacctccactctaggtctgtgctgtccagccaagtagccattggccacatgtggctgctaagcatgtgaaatacagctaatcaagactgaaatattaaaacacacaccagttttagaagactaggaaaaaagcaaacttttattagatgtttatgttgattatatgttggaaagataatattttggatgtgtcaaacgttaaaaattaatttcacccatttttgtgacgtggctactaaggaatttcaggtgatgcttgtggctcctcacacggtttctattggacagtgctgctgcaggtgattcgaaggcgggtgggtgcaggaacccagctgagagttcagaaattagtgtaactttggagacaagtgtctgtgggggaaggagcctccggacgtggagatacaactcttgctcctaacatttatcgagtctttaattaatgccctgggtaactataaggttggaactgtaattgtcaccatattgatgatgagaaacttgagaaaggataagtgacttgtctaaaatcacacagtaaaacctcaaatcaaacccaggccctctggctccagactctaaattatactctgaatgatactcactgattgtccgaggacacaaagagtgtcgaggcactatctgctgggtgtctgcagaaccttactgttctaaagcaaaacattttacccctggacaagagcagcaaaggtggcgttcggccctccttggctctcatttgactgttcaaagccaggtgcttttctttcttgggtcagaacgtattttcagcagcattttgaagcacccctggcgtgcactgcacagggaaaccaggaccacattggtgtgctgtgtcctccttaccaactggctcttggagaaggctgctctttggcgtaaattgcaatcgattagggatcgtttctcagaatcaagttagaagtgagagttcagataagtgaggccgccattgctgctttgaacacctcagaaggggagaatggatttatcaggagtgaaaaagaagagcttgctaggagtcaaagaaaataataaaaagtccagcactagggctccttcacctaccaaacgcaaagaccgctcagatgagaagtccaaggatcgctcaaaagataaaggggccaccaaggagtcgagtgagaaggatcgcggccgggacaaaacccgaaagaggcgcagcgcttccagtggtagcagcagtaccaggtggggcgggctggcctggagcctggagaggacctgtgccacagctacacccccactccccacagatggctcggttttcttgattatttacaaagaaaacacatcctctgattgttagtagagaccctaatttatggcagactggctaggtgcagtggtggctcatgcctataatcccagcactttgggaggccgaggcaggaggattgcttggggcctggagttcaagaccagcatgggcaacaaaacaagagctcgtctctac

SEQ ID NO: 318982 - DNA, 397 bp, Homo sapiens
attgtgccactgcactccagcctgggcgacagagcaagactccatcgctaaataaataatttaattaattaattaattaatttagaaattgcatattttaaaaaaataaattgaaacagtatgcgtcatacagtctggtatgaatgccgcaggaggaacacctagcccagcctattaggaggggtctttgtactgctgactataatcttatccccatctctactaaaaatacaaaaattagccgggcacagtggcacatgcctataatcacagctacttgggaggctaaggcaggagaattgcttgaactcgggaggcagaggttgcagtgagccaagatggtgccactgcactccagcctgtgtgacagagcaagactctgtctcaaaaattaaaa

SEQ ID NO: 318983 - DNA, 319 bp, Homo sapiens
gatgggcacccagcttgtatcaagtttgcaaattcttgggttaaggtgtcccaggccccaggatagggacccagtgagctgctgttgggtgcctaccctggaccccagattcagtcatctgagcacagaaccaagtcctgaggggtggcaatgagaggaaagatcaaagaccttgaacatgggacagaccagaagagaaaagaccaggggggtttggactgtggtccccaagaggaagagagggcacccaaaaccaactgtgcttcaatcactatggcatggccgggggaattgataatgatggtccgagatcaccaaa

SEQ ID NO: 318984 - DNA, 310 bp, Homo sapiens
gggtagaatccatgaacttgggcgccagttgcatattgacgacctgatggtgtaatgagcaggggaggaagacacctcagacggtgctttggcttgggtgactgagctaagggctgctttccctttctggggcgggggggtggccacttggaagctggtgccattatgaggaaggagagggtgcttatgcttatagcccaggaagattgaagccaagaagtgctttcttttttttttggagatggagtcttgctcttgttgcccaggctggagtacagtggcaagatcttggctcactgcaacctctgcc

SEQ ID NO: 318985 - DNA, 1703 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttt

SEQ ID NO: 318986 - DNA, 486 bp, Homo sapiens
tcaaaaaaaaaataaattgtacccattttatacttaacgtagtataaagatgtatgtttaaaaagatgtatattaagatgttaatgttggtttcttcggtggatgggattacaggcgtgagccactatgtctggcctgttttttgttttgagaagtctgttgtgaggttttagttaaatttacgttaacaaattttcattttgtttgtgttgttccttaatctgtttctttcttcactttcagttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttt

SEQ ID NO: 318987 - DNA, 482 bp, Homo sapiens
tcaaaaaaaaaataaattgtacccattttatacttaacgtagtataaagatgtatgtttaaaaagatgtatattaagatgttaatgttggtttcttcggtggatgggattatgaattttatatattcttttctgttaatgatatagcttttgtaataagaaaccagcaggccgggtgtggtggctcacgcctgtaatcccagcactttgagaggctgaggcaggccaattacgaggtcaggagataacgactctctgaatacacatatagggtgcacacagcacggtgtgctaacacggtgaaaccccatctctactaaaaatacaaaaacaaaattagcctggtgtggtggcgggcgcctgtagtcccagctactcaggaagctgaggcgggagaatggcgtgaaccctggaggcggagcttgcagtgagctaagattgcgctgctgccccccagcatgggccacagagtgagactccgtc

SEQ ID NO: 318988 - DNA, 1928 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318989 - DNA, 1921 bp, Homo sapiens
cttaaggcgtctgttctcggcagcggcacagcgaggtcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318990 - DNA, 1946 bp, Homo sapiens
ccggttaatttcagtacggggccgcgggtttgcttgtactttcatgggccgctgcgcagtacacatttaggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318991 - DNA, 1897 bp, Homo sapiens
acgcacgtctctcgctttcgcatacttaaggcgtctgttctcggcagcggcgtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318992 - DNA, 2251 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaactttaaaaaaaaaaaaaaaaaaaaaaaactttgtgggccgccccggggacccggaaaaagtttttcaagacccttccgtgtgggggccgggcgacccagttggtttacaggtgaaccccgggtcgacaaggcggctgccaaagggacacccgggccgggacactgtgctcggttgctccacccataaaaaaccgcccgggcaccgcggcgtttcggaacacaatccgaaggggcgctgtgggcgggcagtgccggggcctatcacaccgggggcccaagcggagggccaagaataacgcgcccggggggggggggaaaaaaaaaaacataaaaacagaaaaggaaggaaggaaagagaagagagaagaagaggattaaaaaatgaaaaaaaaaaaaagaaggataaaaagaagagaagaaaacatgagaaaggaaggaaagagaaaaaaattaaacaaaagaaagaagaaaataaaaatacaagtaaagaagagatgaaaaaaaatgatagataatgaatagaaaaaagaataagaataatagtaaaacgatagacctaaagaaaatatacc

SEQ ID NO: 318993 - DNA, 1873 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaagatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318994 - DNA, 1905 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcgtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318995 - DNA, 2192 bp, Homo sapiens
tggggtctcttgctgtattgcccaggctggtctcgaattcctggcttcaattaatgctgcctctgcgtcccagagtgttgggaatacaggcctgagccaccacgccgtgacatgagggtctttatgactcacaatctgaaaggcagggaagattagagccctgctgtggagcaggtgaaaggagagcagaaggtcagagagattgtttcctgaggcctaacccatcaatttaataagactgtaataagggctatgggagctgtgagccaggaactatggatgaaaacttgtatatagccatatctcctagcaccacaaatcctcttttaatagctttattcctcgtttgcctaatttcaaaaaagactcatttacacaaaaatttctttggaagagagagttagtccaaaatcctagaaggaaaagagttgtatttagataaaggggagtcctcctttttctgacacctatgaaacacctcttgaagttagagagtctgtggctccattgcccccgtgcagaagccatgtctactctctttcttcatggacacttaacaagctgtgacactgggcccgagtcctgcctcctcgcagttaagatgttattaggtacgggggcttgctggaagaaggtacctaagtgcctctggagcccaggccttggagtgcagctgtggcgtggcctgtcctccctctaatcccactgcttttgtttccttgaataggtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318996 - DNA, 1029 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacggtaggagcccctcttgtcaagtttactaaaacactgggccgcatttataaaggattttatgtcgtaatttcaaaaacttt

SEQ ID NO: 318997 - DNA, 1412 bp, Homo sapiens
gtggtgggaggatcgcttgaggtcaggaggctgaggctgcagtgagctttgattgtgccactgtacttcagccagggcaacagagcaagaccctgtctcaaacaaaacaaaacaacccatcttttataatcctcattgtggtttgaaccaataattctaaatttaaaaattaggtgactatttatttatcagtgtttcgtttagaatcgtattccatgtggtgcacattgtgaaatgttaagtaggatacagaatggaggcctgtgtgacggaagtggtgataggatggaggacagggctggggctgctgggtctgcaccagatatcacggtgtgaccttttccaccagggtctccctggatcctggcttggcccaccctcaagtcctagaaggaaggatgagtatgtaacaggatttgtctttgtccttcagtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318998 - DNA, 1021 bp, Homo sapiens
aaatcctctaccctctccgaatcctccgcatctggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 318999 - DNA, 340 bp, Homo sapiens
tgcagacagactgttgagagaggagaatctcgtatattttggacctgcagccaggattccttaaaattagcaatggaagcaagtccagtcttacacttgtatgagtaatttaatcgcctcaaacactctttctttttgcagccgagtgcttatttctacagatgtctgggccagggggttggatgtccctcaggtgtccctcatcattaactatgatctccctaataacagagaattgtacatacacaggtaaggtgcaagctctcattggcttcacttctgtgacacatttactaaatcttgattgttatatatactaactgtaatattattttattcc

SEQ ID NO: 319000 - DNA, 686 bp, Homo sapiens
tggtttcgagataataatggcataaataataatcggtgatcatctcggaggagaaacagtctttctttttggaaaacgtggatgtttctctctcccaccctggacgtgaacctgtgctttgtttcagggctgcttgctctcggtgactacatgaatgtccagtgccatgcctgcattggaggcaccaatgttggcgaggacatcaggaagctggattacggacagcatgttgtcgcgggcactccagggcgtgtttttggtaagcacttttgtcgctaaaaatggtgctgccggtagtatttgtaagaagtgcttaaatggtacaggacagctttcgatttggtaggccgcacggtagacttttgcacctgggtcacttgcaggaggtagagggaaggtctctggaaccctgagaccagtggaatgatgagctctttcttgggagcctcaggtgtgattatttcaaaatctcatagatgtgatttgtcgtaagtatttcaaaatctcatgttatagatatgattcgtcgcagaagcctaaggacacgtgctatcaaaatgttggttttggatgaagctgatgaaatgttgaataaaggtatgagcaacaaaagaattactcttctactgacataattcttagttcttaaattttcacagtgtaaaattgaaacagccagtgactgt

SEQ ID NO: 319001 - DNA, 1948 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaacttttcccataaactctatacttctaaggtgccaccaccttctctagtaacttactgtgtagtcttgggtcatttcactcacttttctttttttcttttctttttcttttttttttttgagacagtctccctctgttgcccaggcaggagcgcagtggcgtgatctcctctcaccgcaagctccacttcctgggttcatgccattctcctacctcagcctcccacgtagctgggagtacaggcggccgc

SEQ ID NO: 319002 - DNA, 1987 bp, Homo sapiens
  misc_feature (1714)..(1714): n is a, c, g, or t
  misc_feature (1723)..(1723): n is a, c, g, or t
  misc_feature (1796)..(1796): n is a, c, g, or t
  misc_feature (1883)..(1883): n is a, c, g, or t
  misc_feature (1943)..(1943): n is a, c, g, or t
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaagtctttttcattaaaaatttaaaactttaggaaaaggaaaaaaaaagatctttagttangcggcgcancctaatccgttagtgggggtaattagcctgcaatgcggtcgtttagacggcgtcatggaaacttgcggtccanctactcctgaggacccctttcactgtatacgaagcgacgatcgtcacatccatgaaggatgcgcgttagcgtaggggttgtttcggntgtaatcgggcggggtctctctctcgggcgccaaagggtggtttcccaaaaggtggccanatttcggtagtgcactgttagggaaacaaaaggggttaaagctg

SEQ ID NO: 319003 - DNA, 1706 bp, Homo sapiens
acgcacgtctctcgctttcgcatacttaaggcgtctgttctcggcagcggcggcacagcgaggtcggcagcggcacagcgaggtcggcagcggcacagcgaggtcggcagcggcacagcgaggtcggcagcggcagcgaggtcggcagcggcacagcgaggtcggcagcggcagcgaggtcggcagcggcgcgcgctgtgctcttccgcggactctgaatcatggcgaccacggccacgatggcgacctcgggctcggcgcgaaagcggctgctcaaagaggaagacatgactaaagtggaattcgagaccagcgaggaggtggatgtgacccccacgttcgacaccatgggcctgcgggaggacctgctgcggggcatctacgcttacggttttgaaaaaccatcagcaatccagcaacgagcaatcaagcagatcatcaaagggagagatgtcatcgcacagtctcagtccggcacaggaaaaacagccaccttcagtatctcagtcctccagtgtttggatattcaggttcgtgaaactcaagctttgatcttggctcccacaagagagttggctgtgcagatccagaaggggctgcttgctctcggtgactacatgaatgtccagtgccatgcctgcattggaggcaccaatgttggcgaggacatcaggaagctggattacggacagcatgttgtcgcgggcactccagggcgtgtttttgatatgattcgtcgcagaagcctaaggacacgtgctatcaaaatgttggttttggatgaagctgatgaaatgttgaataaaggtttcaaagagcagatttacgatgtatacaggtacctgcctccagccacacaggtggttctcatcagtgccacgctgccacacgagattctggagatgaccaacaagttcatgaccgacccaatccgcatcttggtgaaacgtgatgaattgactctggaaggcatcaagcaatttttcgtggcagtggagagggaagagtggaaatttgacactctgtgtgacctctacgacacactgaccatcactcaggcggtcatcttctgcaacaccaaaagaaaggtggactggctgacggagaaaatgagggaagccaacttcactgtatcctcaatgcatggagacatgccccagaaagagcgggagtccatcatgaaggagttccggtcgggcgccagccgagtgcttatttctacagatgtctgggccagggggttggatgtccctcaggtgtccctcatcattaactatgatctccctaataacagagaattgtacatacacagaattgggagatcaggtcgatacggccggaagggtgtggccattaactttgtaaagaatgacgacatccgcatcctcagagatatcgagcagtactattccactcagattgatgagatgccgatgaacgttgctgatcttatctgaagcagcagatcagtgggatgagggagactgttcacctgctgtgtactcctgtttggaagtatttagatccagattctacttaatggggtttatatggactttcttctcataaatggcctgccgtctcccttcctttgaagaggatatggggattctgctctcttttcttatttacatgtaaataatacattgttctaataactctcattaatgtaacttcatcttttttgttgtgttgtttgttctgtt
